(12) United States Patent
Mascia

(10) Patent No.: US 7,476,777 B2
(45) Date of Patent: Jan. 13, 2009

(54) BIOLOGICAL CONTAINMENT SYSTEM

(75) Inventor: Peter N. Mascia, Thousand Oaks, CA (US)

(73) Assignee: Ceres, Inc., Thousand Oaks, CA (US)

( * ) Notice: Subject to any disclaimer, the term of this patent is extended or adjusted under 35 U.S.C. 154(b) by 480 days.

(21) Appl. No.: 10/873,679

(22) Filed: Jun. 22, 2004

(65) Prior Publication Data

US 2007/0039066 A1    Feb. 15, 2007

Related U.S. Application Data

(63) Continuation-in-part of application No. 10/667,295, filed on Sep. 17, 2003, now abandoned.

(60) Provisional application No. 60/411,823, filed on Sep. 17, 2002.

(51) Int. Cl.
*C12N 15/82* (2006.01)
*A01H 5/00* (2006.01)
*A01H 5/10* (2006.01)
*C12P 21/00* (2006.01)

(52) U.S. Cl. ............... 800/278; 800/288; 800/300; 435/69.1

(58) Field of Classification Search ............ None
See application file for complete search history.

(56) References Cited

U.S. PATENT DOCUMENTS

| | | |
|---|---|---|
| 4,654,465 A | 3/1987 | Brar et al. |
| 4,727,219 A | 2/1988 | Brar et al. |
| 4,761,373 A | 8/1988 | Anderson et al. |
| 4,769,061 A | 9/1988 | Comai |
| 4,810,648 A | 3/1989 | Stalker |
| 4,936,904 A | 6/1990 | Carlson |
| 4,940,835 A | 7/1990 | Shah et al. |
| 4,946,778 A | 8/1990 | Ladner et al. |
| 4,975,374 A | 12/1990 | Goodman et al. |
| 5,004,864 A | 4/1991 | Robertson et al. |
| 5,013,659 A | 5/1991 | Bedbrook et al. |
| 5,034,323 A | 7/1991 | Jorgensen et al. |
| 5,162,602 A | 11/1992 | Somers et al. |
| 5,204,253 A | 4/1993 | Sanford et al. |
| 5,276,268 A | 1/1994 | Strauch et al. |
| 5,432,068 A | 7/1995 | Albertsen et al. |
| 5,538,880 A | 7/1996 | Lundquist et al. |
| 5,554,798 A | 9/1996 | Lundquist et al. |
| 5,561,236 A | 10/1996 | Leemans et al. |
| 5,591,616 A | 1/1997 | Hiei et al. |
| 5,704,160 A | 1/1998 | Bergquist et al. |
| 5,706,603 A | 1/1998 | Bergquist et al. |
| 5,723,765 A | 3/1998 | Oliver et al. |
| 5,767,366 A | 6/1998 | Sathasivan et al. |
| 5,773,697 A | 6/1998 | Tomes et al. |
| 5,824,779 A | 10/1998 | Koegel et al. |
| 5,824,798 A | 10/1998 | Tallberg et al. |
| 5,879,903 A | 3/1999 | Strauch et al. |
| 5,880,333 A | 3/1999 | Goff et al. |
| 5,900,525 A | 5/1999 | Austin-Phillips et al. |
| 5,907,082 A | 5/1999 | O'Neill et al. |
| 5,922,934 A | 7/1999 | Bergquist et al. |
| 5,928,937 A | 7/1999 | Kakefuda et al. |
| 5,958,745 A | 9/1999 | Gruys et al. |
| 6,013,863 A | 1/2000 | Lundquist et al. |
| 6,063,985 A | 5/2000 | Chua et al. |
| 6,084,155 A | 7/2000 | Volrath et al. |
| 6,087,558 A | 7/2000 | Howard et al. |
| 6,093,874 A | 7/2000 | Jofuku et al. |
| 6,127,606 A | 10/2000 | Bennett et al. |
| 6,136,320 A | 10/2000 | Arntzen et al. |
| 6,147,282 A | 11/2000 | Goff et al. |
| 6,229,064 B1 | 5/2001 | Fischer et al. |
| 6,232,526 B1 | 5/2001 | McElroy et al. |
| 6,235,974 B1 | 5/2001 | Qiu et al. |
| 6,235,975 B1 | 5/2001 | Harada et al. |
| 6,248,940 B1 | 6/2001 | Berquist |
| 6,255,562 B1 | 7/2001 | Heyer et al. |
| 6,255,564 B1 | 7/2001 | Fabijanski et al. |
| 6,262,334 B1 | 7/2001 | Endege et al. |
| 6,262,341 B1 | 7/2001 | Baszczynski et al. |
| 6,271,016 B1 | 8/2001 | Anderson et al. |
| 6,303,341 B1 | 10/2001 | Hiatt et al. |

(Continued)

FOREIGN PATENT DOCUMENTS

EP        0 242 246        10/1987

(Continued)

OTHER PUBLICATIONS

Sessa et al. Plant Molecular Biology 29: 969-982 (1995).*

(Continued)

*Primary Examiner*—David T Fox
(74) *Attorney, Agent, or Firm*—Fish & Richardson P.C.

(57) ABSTRACT

The invention relates to materials and methods useful for controlling the unwanted spread of transgenic traits. The methods involve an apomictic plant containing a transgene for a desired trait and a transgene causing seed infertility. The methods also involve one or more transcription activators that activates expression of both transgenes carried by the apomictic plant. The transcription activator(s) activates expression of both transgenes in the female. Seeds that are formed on such plants are infertile.

14 Claims, No Drawings

U.S. PATENT DOCUMENTS

| | | | |
|---|---|---|---|
| 6,320,102 | B1 | 11/2001 | Harada et al. |
| 6,326,527 | B1 | 12/2001 | Kirihara et al. |
| 6,329,571 | B1 | 12/2001 | Hiei |
| 6,362,394 | B1 | 3/2002 | Crossland et al. |
| 6,392,119 | B1 | 5/2002 | Gutterson et al. |
| 6,399,856 | B1 | 6/2002 | Cigan et al. |
| 6,417,429 | B1 | 7/2002 | Hein et al. |
| 6,451,732 | B1 | 9/2002 | Beckett et al. |
| 6,451,735 | B1 | 9/2002 | Ottaway et al. |
| 6,492,577 | B1 | 12/2002 | Harada et al. |
| 6,541,610 | B1 | 4/2003 | Smith |
| 6,559,357 | B1 | 5/2003 | Fischer et al. |
| 6,781,035 | B1 | 8/2004 | Harada et al. |
| 6,815,577 | B1 | 11/2004 | Harper et al. |
| 6,825,397 | B1 * | 11/2004 | Lowe et al. .................. 800/278 |
| 6,906,244 | B2 | 6/2005 | Fischer et al. |
| 6,946,586 | B1 | 9/2005 | Fromm et al. ............... 800/278 |
| 2001/0016956 | A1 | 8/2001 | Ward et al. |
| 2002/0081667 | A1 | 6/2002 | Gorlach et al. |

FOREIGN PATENT DOCUMENTS

| | | |
|---|---|---|
| EP | 329308 | 2/1989 |
| EP | 0 823 480 | 2/1998 |
| EP | 1 461 438 | 9/2004 |
| WO | 90/08828 | 8/1990 |
| WO | 97/31064 | 8/1997 |
| WO | 98/08961 | 3/1998 |
| WO | 98/28431 | 7/1998 |
| WO | 98/36083 | 8/1998 |
| WO | 98/36090 | 8/1998 |
| WO | 98/53083 | 11/1998 |
| WO | 99/32619 | 7/1999 |
| WO | 99/53050 | 10/1999 |
| WO | 99/67405 | 12/1999 |
| WO | 00/24914 | 5/2000 |
| WO | 00/28058 | 5/2000 |
| WO | 00/37660 | 6/2000 |
| WO | 00/40694 | 7/2000 |
| WO | 2004/027038 | 4/2004 |
| WO | WO2004/027038 | 4/2004 |

OTHER PUBLICATIONS

Kandasamy et al. The Plant Cell 5(3): 263-275 (Mar. 1993).*
GenBank Accession No. ACC39488.
GenBank Accession No. J02798.
GenBank Accession No. J05212.
GenBank Accession No. L05934.
GenBank Accession No. M63985.
GenBank Accession No. U09118.
GenBank Accession No. U09119.
GenBank Accession No. U39944.
GenBank Accession No. U93215.
GenBank Accession No. Z17657.
Abler and Scandalios, "Isolation and characterization of a genome sequence encoding the maize Cat3 catalase gene," *Plant Mol. Biol.*, 1993, 22:1031-1038.
Aoyama and Chua, "A glucocorticoid-mediated transcriptional induction system in transgenic plants," *Plant Journal*, 1997, 11(3):605-612.
Austin et al., "An Overview of a Feasibility Study for the Production of Industrial Enzymes in Transgenic Alfalfa," *Annals NY Acad. Sci.*, 1994, 721:234-244.
Austin et al., "Production and field performance of transgenic alfalfa (*Medicago sativa* L.) expressing alpha-amylase and manganese-dependent lignin peroxidase," *Euphytica*, 1995, 85:381-393.
Bai et al., "Isolation and Characterization of *SYN1*, a *RAD21*-like Gene Essential for Meiosis in *Arabidopsis*," *Plant Cell*, 1999, 11:417-430.

Blume and Grierson, "Expression of ACC oxidase promoter—GUS fusions in tomato and *Nicotiana plumbaginifolia* regulated by developmental and environmental stimuli," *Plant J.*, 1997, 12:731-746.
Bossinger and Smyth, "Initiation patterns of flower and floral organ development in *Arabidopsis thaliana*," *Development*, 1996, 122:1093-1102.
Bowman, "Expression of the *Arabidopsis* Floral Homeotic Gene Agamous Is Restricted to Specific Cell Types Late in Flower Development," *Plant Cell*, 1991, 3:749-758.
Bustos et al., "Regulation of β-Glucuronidase Expression in Transgenic Tobacco Plants by an A/T-Rich, cis-Acting Sequence Found Upstream of a French Bean β-Phaseolin Gene," *Plant Cell*, 1989, 1:839-853.
Caddick et al., "An ethanol inducible gene switch for plants used to manipulate carbon metabolism," *Nat. Biotechnology*, 1998, 16(2):177-180.
Chen and Foolad, "Molecular organization of a gene in barley which encodes a protein similar to aspartic protease and its specific expression in nucellar cells during degeneration," *Plant Mol. Biol.*, 1997, 35:821-831.
Choi et al., "Tissue-specific and developmental regulation of a gene encoding a low molecular weight sulfur-rich protein in soybean seeds," *Mol. Gen. Genet.*, 1995, 246:266-268.
Colombo et al., "Downregulation of Ovule-Specific MADS Box Genes from Petunia Results in Maternally Controlled Defects in Seed Development," *Plant Cell*, 1997, 9:703-715.
Conceição and Krebbers, "A cotyledon regulatory region is responsible for the different spatial expression patterns of *Arabidopsis* 2S albumin genes," *Plant J.*, 1994, 5(4):493-505.
Dasgupta et al., "Cloning and sequencing of 5' flanking sequence from the gene encoding 2S storage protein, from two *Brassica* species,", *Gene*, 1993, 133:301-302.
Dieffenbach and Dveksler (eds.), *PCR Primer: A Laboratory Manual*, 1995, Cold Spring Harbor Laboratory Press (TOC only).
Drews et al., "Negative Regulation of the *Arabidopsis* Homeotic Gene AGAMOUS by the APETALA2 Product," *Cell*, 1991, 65:991-1002.
Ficker et al., "A promoter directing high level expression in pistils of transgenic plants," *Plant Mol. Biol.*, 1997, 35:425-431.
Ficker et al., "Multiple elements of the S2-RNase promoter from potato (*Solanum tuberosum* L.) are required for cell type-specific expression in transgenic potato and tobacco," *Mol. Gen. Genet.*, 1998, 257:132-142.
Gatz, "Chemical Control of Gene expression," *Annual Review of Plant Physiology and Plant Molecular Biology*, 1997, 48:89-108.
Green et al., "Binding site requirements for pea nuclear protein factor GT-1 correlate with sequences required for light-dependent transcriptional activation of the rbcS-3A gene," *EMBO J.*, 1988, 7(13):4035-4044.
Guerrero et al., "Promoter sequences from a maize pollen-specific gene direct tissue-specific transcription in tobacco," *Mol. Gen. Genet.*, 1990, 224(1):161-168.
Gustafson-Brown et al., "Regulation of the *Arabidopsis* Floral Homeotic Gene APETALA1," *Cell*, 1994, 76(1):131-143.
Ji and Langridge, "An early meiosis cDNA clone from wheat," *Mol. Gen. Genet.*, 1994, 243(1):17-23.
Jordano et al., "A Sunflower Helianthinin Gene Upstream Sequence Ensemble Contains an Enhancer and Sites of Nuclear Protein Interaction," *Plant Cell*, 1989, 1:855-866.
Josefsson et al., "Structure of a Gene Encoding the 1.7 S Storage Protein, Napin, from *Brassica napus*," *J. Biol. Chem.*, 1987, 262:12196-12201.
Klimyuk and Jones, "AtDMC1, the *Arabidopsis* homologue of the yeast DMC1 gene: characterization, transposon-induced allelic variation and meiosis-associated expression," *Plant J.*, 1997, 11(1):1-14.
Kobayashi et al., "Characterization of cDNAs Induced in Meiotic Prophase in Lily Microsporocytes," *DNA Res.*, 1994, 1:15-26.
Kulikauskas and McCormick, "Identification of the tobacco and *Arabidopsis* homologues of the pollen-expressed LAT59 gene tomato," *Plant Mol. Biol.*, 1997, 34:809-814.
Lee and Huang, "Genes encoding oleosins in maize kernel of inbreds Mo17 and B73," *Plant Mol. Biol.*, 1994, 26(6):1981-1987.

Mandel et al., "Molecular characterization of the *Arabidopsis* floral homeotic gene APETALA1," *Nature*, 1992, 360:273-277.

Meier et al., "Elicitor-Inducible and Constitutive in Vivo DNA Footprints Indicate Novel cis-Acting Elements in the Promoter of a Parsley Gene Encoding Pathogenesis-Related Protein 1," *Plant Cell*, 1991, 3:309-315.

Owen and Pen (eds.), "Transgenic Plants: A Production System for Industrial and Pharmaceutical Proteins," John Wiley & Son Ltd.; Austin, S. et al., 1994. *Annals NY Acad.Sci.*, 1996, 721:234-242.

Ray et al., "*Arabidopsis* floral homeotic gene BELL (BEL1) controls ovule development through negative regulation of AGAMOUS gene (AG)," *Proc. Natl. Acad. Sci. USA*, 1994, 91:5761-5765.

Reiser et al., "The BELL1 Gene Encodes a Homeodomain Protein Involved in Pattern Formation in the *Arabidopsis* Ovule Primordium," *Cell*, 1995, 83:735-742.

Rotino et al., "Genetic engineering of parthenocarpic plants," *Nat. Biotechnol.*, 1997, 15:1398-1401.

Sambrook et al., Molecular Cloning: A Laboratory Manual, 1989, 2nd edition, *Cold Spring Harbor Press*, Plainview, NY, Sections 9.37-9.52.

Schernthaner et al., "Control of seed germination in transgenic plants based on the segregation of a two-component genetic system," *Proc. Natl. Acad. Sci. USA*, 2003, 100:6855-6859.

Sheridan et al., "The mac1 Gene: Controlling the Commitment to the Meiotic Pathway in Maize," *Genetics*, 1996, 142:1009-1020.

Sjödahl et al., "Deletion analysis of the *Brassica napus* cruciferin gene *cru 1* promoter in transformed tobacco: promoter activity during early and late stages of embryogenesis is influenced by *cis*-acting elements in partially separate regions," *Planta*, 1995, 197(2):264-271.

Treacy et al., "Bnm1, a *Brassica* pollen-specific gene," *Plant Mol. Biol.*, 1997, 34:603-611.

Urao et al., "Molecular cloning and characterization of a gene that encodes a MYC-related protein in *Arabidopsis*," *Plant Mol. Biol.*, 1996, 32(3):571-576.

Wakeley et al., "A maize pectin methylesterase-like gene, ZmC5, specifically expressed in pollen," *Plant Mol. Biol.*, 1998, 37:187-192.

Yadegari et al., "Mutations in the FIE and MEA Genes That Encode Interacting Polycomb Proteins Cause Parent-of-Origin Effects on Seed Development by Distinct Mechanisms," *Plant Cell*, 2000, 12:2367-2382.

Zhang et al., "DNA Sequences That Activate Isocitrate Lyase Gene Expression during Late Embryogenesis and during Postgerminative Growth," *Plant Physiology*, 1996, 110:1069-1079.

Ziegelhoffer et al., "Dramatic effects of truncation and sub-cellular targeting on the accumulation of recombinant microbial cellulase in tobacco," *Molecular Breeding*, 2001, 8:147-158.

Ziegelhoffer et al., "Expression of bacterial cellulase genes in transgenic alfalfa (*Medicago sativa* L.), potato (*Solanum tuberosum* L.) and tobacco (*Nicotiana tabacum* L.)," *Molecular Breeding*, 1999, 5:309-318.

Schena et al. "A steroid-inducible gene expression system for plant cells" *Proc. Natl. Acad. Sci. USA*, Dec. 1991, 88:10421-10425.

Lloyd et al. "Epidermal Cell Fate Determination in *Arabidopsis*: Patterns Defined by a Steroid-Inducible Regulator" *Science*, Oct. 21, 1994, 266(5184):436-439.

Bruce et al., "Expression Profiling of the Maize Flavonoid Pathway Genes Controlled by Estradiol-Inducible Transcription Factors CRC and P" *The Plant Cell*, 2000, 12:65-79.

Daniell, "Molecular strategies for gene containment in transgenic crops" *Nature Biotechnology*, 2002, 20(6):581-586.

de Pater et al. Characterization of a zinc-dependent transcriptional activator from *Arabidopsis*, 1996, 24(23):4624-4631.

Escriva et al. "Ligand binding and nuclear receptor evolution" *BioEssays*, 2000, 22:717-727.

Guyer et al. "Activation of Latent Transgenes in Arabidopsis Using a Hybrid Transcription Factor" *Genetics*, 1998, 149:633-639.

Mascia et al. "Safe and acceptable strategies for producing foreign molecules in plants" *Current Opinion in Plant Biology*, 2004, 7:189-195.

Meshi et al. "Plant Transcription Factors" *Plant Cell Physiology*, 1995, 36(8):1405-1420.

Olefsky "Nuclear Receptor Minireview Series" *The Journal of Biological Chemistry*, 2001, 276(4):36863-36864.

Riechmann et al. "A genomic perspective on plant transcription factors" *Current Opinion in Plant Biology*, 2000, 3:423-434.

Riechmann et al. "*Arabidopsis* Transcription Factors: Genome-Wide Comparative Analysis Among Eukaryotes" *Science*, 2000, 290:2105-2110.

Struhl "Helix-turn-helix, zinc finger, and leucin-zipper motifs for eukaryotic transcriptional regulatory proteins" *TIBS*, 1989, 137-140.

Batard et al. "Increasing expression of P450 and P450-reductase proteins from monocots in heterologous systems" *Arch. Biochem. Biophys.* 379:161-169 (2000).

Campbell and Gowri "Codon usage in higher plants, green algae, and cyanobacteria" *Plant Physiology*, 92:1-11(1990).

Place database release 11.0, obtained from the Internet at http://ftp.dna.affrc.go.jp/pub/dna_place/r11.0/place.seq, document dated Sep. 10, 2002, 181 pages.

Rouwendal et al. "Enhanced expression in tobacco of the gene encoding green fluorescent protein by modification of its codon usage" *Plant Mol. Biol.*, 33:989-999 (1997).

Streatfield et al. "Plant-based vaccines: unique advantages" *Vaccine*, 19:2742-2748 (2001).

Streatfield "Approaches to achieve high-level heterologous protein production in plants" *Plant Biotechnology*, 5:2-15 (2007).

* cited by examiner

BIOLOGICAL CONTAINMENT SYSTEM

CROSS REFERENCE TO RELATED APPLICATION

This application claims priority to and is a continuation-in-part of U.S. application Ser. No. 10/667,295, filed Sep. 17, 2003, now abandoned, and U.S. Provisional Application No. 60/411,823, filed Sep. 17, 2002, both of which are incorporated by reference in their entirety.

REFERENCE TO TABLE SUBMITTED ON A COMPACT DISC

This application includes a compact disc (Disc 1 of 2, submitted in duplicate) containing Tables. The entire contents of the Tables are herein incorporated by reference. The Tables are identified on the compact disc as follows.

The compact disc contains Reference Tables designated: reference_table1__4565.710-0004-55300-US-U-36440.01__1.txt; reference_table2__3847.710-0004-55300-US-U-36440.01__1.txt; reference_table3__3769.710-0004-55300-US-U-36440.01__1.txt; reference_table4__3708.710-0004-55300-US-U-36440.01__1.txt; and reference_table5__311987.710-0004-55300-US-U-36440.01__1.txt. The compact disc also contains an ortholog table designated ortholog.txt.

| File name | Size (kilobytes) | Date of Creation |
|---|---|---|
| reference_table1__311987.710-0004-55300-US-U-36440.01__1.txt | 59.9 KB | Feb. 29, 2004 |
| reference_table2__3708.710-0004-55300-US-U-36440.01__1.txt | 82.2 KB | Feb. 26, 2004 |
| reference_table3__3769.710-0004-55300-US-U-36440.01__1.txt | 99.1 KB | Feb. 26, 2004 |
| reference_table4__3847.710-0004-55300-US-U-36440.01__1.txt | 110 KB | Feb. 26, 2004 |
| reference_table5__4565.710-0004-55300-US-U-36440.01__1.txt | 44.5 KB | Feb. 26, 2004 |
| Ortholog.txt | 6.00 KB | Mar. 15, 2004 |

The compact disc also contains a Consensus Sequence Table containing consensus sequences designated: 12514_gly_bra; 12514; 12653917; 23771; 3000_dico; 3000; 1610; 519; 8916; 38419_mono; 38419; 38419_dico; 32791; 32348; 5605; 5605_gly_bra; and 519_gly.

| File Name | Size (kilobytes) | Date of Creation |
|---|---|---|
| Consensus Sequence Table.txt | 16.5 KB | May 4, 2004 |

The compact disc also contains Matrix Tables designated 12514_gly_bra_matrix_table1.txt; 12514_matrix_table2.txt; 12653917_matrix_table3.txt; 23771-matrix_table4.txt; 3000_dico_matrix_table5.txt; 3000_matrix_table6.txt; 1610_matrix_table7.txt; 519_matrix_table8.txt; 8916_matrix_table9txt; 38419_mono_matrix_table10.txt; 38419_matrix_table11.txt; 38419_dico_matrix_table12.txt; 32791_matrix_table13.txt; 32348_matrix_table14.txt; 5605_matrix_table15.txt; 5605_gly_bra_matrix_table16.txt; and 519_gly_matrix_table17.txt.

| File Name | Size (kilobytes) | Date of Creation |
|---|---|---|
| 12514_gly_bra_matrix_1.txt | 4.55 KB | Apr. 13, 2004 |
| 12514_matrix_2.txt | 5.19 KB | Apr. 13, 2004 |
| 12653917_matrix_3.txt | 48.6 KB | Apr. 21, 2004 |
| 1610_matrix_7.txt | 6.39 KB | Apr. 9, 2004 |
| 23771_matrix_4.txt | 5.07 KB | Apr. 8, 2004 |
| 3000_dico_matrix_5.txt | 11.7 KB | Apr. 23, 2004 |
| 3000_matrix_6.txt | 10.4 KB | Apr. 9, 2004 |
| 32348_matrix_14.txt | 18.4 KB | Apr. 23, 2004 |
| 32791_matrix_13.txt | 9.21 KB | Apr. 13, 2004 |
| 38419_dico_matrix_12.txt | 12.5 KB | Apr. 23, 2004 |
| 38419_matrix_11.txt | 14.1 KB | Apr. 21, 2004 |
| 38419_mono_matrix_10.txt | 12.4 KB | Apr. 14, 2004 |
| 519_gly_matrix_17.txt | 2.07 KB | Apr. 9, 2004 |
| 519_matrix_8.txt | 4.14 KB | Apr. 9, 2004 |
| 5605_gly_bra_matrix_16.txt | 3.26 KB | Apr. 22, 2004 |
| 5605_matrix_15.txt | 3.12 KB | Apr. 9, 2004 |
| 8916_matrix_9.txt | 7.70 KB | Apr. 16, 2004 |

All of the above computer files are incorporated by reference in their entirety.

REFERENCE TO SEQUENCE LISTING SUBMITTED ON A COMPACT DISC

This application includes a compact disc (Disc 2 of 2, submitted in duplicate) containing a sequence listing. The entire content of the sequence listing is herein incorporated by referenced. The sequence listing is identified on the compact disc as follows.

| File Name | Size (bytes) | Date of Creation |
|---|---|---|
| 11696-109001.TXT | 606,208 | Jun. 21, 2004 |

The invention relates to methods and materials for maintaining the integrity of the germplasm of transgenic and conventionally bred plants. In particular, the invention pertains to methods and materials that can be used to minimize the unwanted transmission of transgenic traits.

BACKGROUND

Transgenic plants are now common in the agricultural industry. Such plants express novel transgenic traits such as insect resistance, stress tolerance, improved oil quality, improved meal quality and heterologous protein production. As more and more transgenic plants are developed and introduced into the environment, it is important to control the undesired spread of transgenic traits from transgenic plants to other traditional and transgenic cultivars, plant species and breeding lines.

While physical isolation and pollen trapping border rows have been employed to control transgenic plants under study conditions, these methods are cumbersome and are not practical for many cultivated transgenic plants. Effective ways to control the transmission and expression of transgenic traits without intervention would be useful for managing transgenic plants.

One recent genetic approach involves the production of transgenic plants that comprise recombinant traits of interest linked to repressible lethal genes. See, WO 00/37660. The lethal genes are blocked by the action of repressor molecules produced by repressor genes located at a different genetic locus. The lethal phenotype is expressed only if the repressible lethal gene construct and the repressor gene segregate after meiosis. This approach reportedly can be used to maintain genetic purity by blocking introgression of genes from plants that lack the repressor gene.

SUMMARY

The present invention features methods and materials useful for controlling the transmission and expression of transgenic traits. The methods and materials of the invention facilitate the cultivation of transgenic plants without the undesired transmission of transgenic traits to other plants.

The invention features a method for making infertile seed. The method comprises permitting seed development to occur on a plurality of first plants that have been pollinated by a plurality of second plants. The first plants are male-sterile and comprise first and second nucleic acids. The first nucleic acid comprises a first transcription activator recognition site and a first promoter, operably linked to a sequence to be transcribed. The second nucleic acid comprises a second transcription activator recognition site and a second promoter, operably linked to a coding sequence causing seed infertility. The second plants are male-fertile and comprise at least one activator nucleic acid comprising at least one coding sequence for a transcription activator that is effective for binding to at least one of the above recognition sites. Each transcription activator coding sequence has a promoter operably linked thereto. The resulting seeds are infertile. The at least one activator nucleic acid can be a single nucleic acid encoding a single transcription activator that binds to both the first and second recognition sites. In some embodiments, the at least one activator nucleic acid is two nucleic acids, each encoding different transcription activators, one of which can bind the first recognition site and the other of which can bind the second recognition site. Alternatively, the at least one activator nucleic acid can be a single nucleic acid encoding a first transcription activator that can bind the first recognition site and encoding a second transcription activator that can bind the second recognition site. The promoter for the transcription activator can be seed-specific, or can be chemically inducible. The plants can be dicotyledonous plants, or monocotyledonous plants. The method can further comprise the step of harvesting the seeds. The plurality of first plants can be cytoplasmically male-sterile, or genetically male-sterile.

In some embodiments, the sequence to be transcribed encodes a preselected polypeptide, and the seeds can have a statistically significant increase in the amount of the preselected polypeptide relative to seeds that do not contain or express the first nucleic acid. The preselected polypeptide can be an antibody, or an industrial enzyme.

The sequence causing seed infertility can encode a seed infertility polypeptide, such as a loss-of-function mutant FIE polypeptide, a LEC2 polypeptide, an ANT polypeptide, or a LEC1 polypeptide.

The invention also features a method for making a polypeptide, which comprises obtaining seed produced by pollination of a male-sterile plant. Such seed comprises a first nucleic acid comprising a first recognition site for a transcription activator and a first promoter, operably linked to a sequence to be transcribed. Such seed also comprises a second nucleic acid comprising a second recognition site for a transcription activator and a second promoter, operably linked to a sequence causing seed infertility. Such seed also comprises at least one activator nucleic acid comprising at least one coding sequence for a transcription activator that binds to at least one of said recognition sites, each of the at least one transcription activators having a promoter operably linked thereto. The seeds are infertile and have a statistically significant increase in the amount of an endogenous polypeptide relative to seeds that do not contain or express said first nucleic acid. The endogenous polypeptide can be extracted from the seed.

A method for making a polypeptide can comprise permitting a plurality of first, male-sterile, plants to be pollinated by a plurality of second plants. The first plants comprise a first nucleic acid comprising a first transcription activator recognition site and a first promoter, operably linked to a coding sequence encoding a preselected polypeptide; and a second nucleic acid comprising a second transcription activator recognition site and a second promoter, operably linked to a sequence causing seed infertility. The second plants comprise at least one activator nucleic acid encoding at least one transcription activator that binds to at least one of the recognition sites. Each of the at least one transcription activators has a promoter operably linked thereto. The method also comprises harvesting seeds from the plurality of first plants. The resulting said seeds are infertile and have a statistically significant increase in the amount of preselected polypeptide relative to seeds that do not contain or express the first nucleic acid. The method can also comprise extracting the preselected polypeptide from the seeds. The plurality of first plants and said plurality of second plants can be randomly interplanted.

The invention also features an article of manufacture, which comprises a container, a first type of seeds within the container, and a second type of seeds within the container. The first type of seeds comprise at least one first nucleic acid comprising a first transcription activator recognition site and a first promoter, operably linked to a sequence to be transcribed, and a second transcription activator recognition site and a second promoter, operably linked to a sequence causing seed infertility. Plants grown from the first type of seeds are male-sterile. The second type of seeds comprise at least one activator nucleic acid, which encodes one or more transcription activators that are effective for binding to a corresponding one or more of the recognition sites, each transcription activator coding sequence has a promoter operably linked thereto. Plants grown from the second type of seeds are male-fertile. The sequence to be transcribed can encode a preselected polypeptide. The ratio of the first type of seeds to the second type of seeds can be about 70:30 or greater. The first and second types of seeds can be monocotyledonous seeds or dicotyledonous seeds. The invention also features a plant grown from one of the above types of seeds.

The invention also features a nucleic acid construct comprising a first transcription activator recognition site and a first promoter. The first recognition site and first promoter are operably linked to a sequence to be transcribed. The nucleic acid construct also comprises a second transcription activator recognition site and a second promoter, each of which are operably linked to a second coding sequence encoding a seed infertility factor. The sequence causing seed infertility can be transcribed into a FIE antagonist, e.g., a FIE antisense RNA, or a ribozyme, or a chimeric polypeptide comprising a polypeptide segment exhibiting histone acetyltransferase activity fused to a polypeptide segment exhibiting activity of a subunit of a chromatin-associated protein complex having histone deacetylase activity. The sequence to be transcribed in the nucleic acid construct can encode a preselected polypeptide, e.g., an antibody, a polypeptide that has immunogenic activity in a mammal, or an industrial enzyme such as glucose-6-phosphate dehydrogenase or alpha-amylase. The sequence causing seed infertility can encode a LEC2 polypeptide, an ANT polypeptide or a LEC1 polypeptide.

The invention also features a method for making infertile seed. A plurality of male-sterile first plants are provided for the method, each such plant comprising a first nucleic acid and a second nucleic acid. The first nucleic acid comprises a first transcription activator recognition site and a first promoter. The first recognition site and the first promoter are operably linked to a sequence to be transcribed. The second nucleic acid comprises a second transcription activator recognition site and a second promoter. The second recognition site and the second promoter are operably linked to a sequence that results in seed infertility. A plurality of male-fertile second plants are provided for the method, each such plant comprising at least one activator nucleic acid. The activator nucleic acid comprises at least one coding sequence for a transcription activator that binds to at least one of the recognition sites, and each at least one transcription activator coding sequence has a promoter operably linked to it. Seed development is permitted to occur on the first plants after pollination by pollen from the second plants. The seeds are infertile such that the seeds produce no seedlings or seedlings that are not fertile.

The invention also features a method for making infertile seed. The method comprises growing a plurality of apomictic plants that comprise first and second nucleic acids, wherein seeds that form on the plants are infertile. The first nucleic acid comprises a first transcription activator recognition site and a first promoter, the first recognition site and first promoter operably linked to a sequence to be transcribed. The second nucleic acid comprises a second transcription activator recognition site and a second promoter, the second recognition site and second promoter operably linked to a coding sequence that results in seed infertility. Such plants comprise at least one activator nucleic acid having at least one coding sequence for a transcription activator that binds to at least one of the recognition sites, each transcription activator coding sequence having a promoter operably linked thereto. The at least one activator nucleic acid can be a single nucleic acid encoding a first transcription activator that binds the first recognition site and a second transcription activator that binds the second recognition site.

The promoter for the first transcription activator can be a constitutive promoter and the promoter for the second transcription activator can be a seed-specific promoter. The promoter for the first transcription activator can be a maize ubiquitin promoter. The promoter for the first transcription activator can be a vegetative tissue-specific promoter and the promoter for the second transcription activator can be a seed-specific promoter. The apomictic plants can be dicotyledonous plants or monocotyledonous plants. The sequence to be transcribed can encode a preselected polypeptide. Expression of the preselected polypeptide can confer herbicide resistance. The sequence causing seed infertility can encode a seed infertility polypeptide. The seed infertility polypeptide can be a loss-of-function mutant FIE polypeptide, an ANT polypeptide, or a LEC1 polypeptide.

The invention also features a method for making a polypeptide. The method comprises growing a plurality of apomictic plants, each of such plants comprising a first nucleic acid and a second nucleic acid. The first nucleic acid comprises a first transcription activator recognition site and a first promoter, the first recognition site and first promoter operably linked to a nucleic acid encoding a preselected polypeptide. The second nucleic acid comprises a second transcription activator recognition site and a second promoter, the second recognition site and second promoter operably linked to a sequence causing seed infertility. Each plant also has at least one activator nucleic acid encoding at least one transcription activator that binds to at least one of the recognition sites, each transcription activator nucleic acid having a promoter operably linked thereto. The method further comprises expressing the preselected polypeptide in the plants. The plants have a statistically significant increase in the preselected polypeptide relative to plants that do not contain or express the first nucleic acid. Seeds that develop on the plants are infertile.

The invention also features an article of manufacture comprising a container, and seeds from an apomictic species within the container. The seeds comprise at least one first nucleic acid comprising a first transcription activator recognition site and a first promoter, the first recognition site and first promoter operably linked to a sequence to be transcribed. The seeds also comprise a second transcription activator recognition site and a second promoter, the second recognition site and second promoter operably linked to a sequence causing seed infertility. Plants grown from the seeds are infertile and further contain at least one activator nucleic acid encoding at least one transcription activator that binds to at least one of the recognition sites. Each transcription activator has a promoter operably linked thereto.

The sequence to be transcribed can be a preselected polypeptide. The at least one first nucleic acid can comprise a nucleic acid comprising the first transcription activator recognition site, the first promoter and the sequence to be transcribed, and a different nucleic acid comprising the second transcription activator recognition site, second promoter and a seed infertility polypeptide coding sequence. The at least one activator nucleic acid can encode a transcription activator that binds to the first recognition site, and a different transcription activator that binds to the second recognition site. The promoter for the transcription activator that binds the first recognition site can be a vegetative tissue-specific promoter and the promoter for the transcription activator that binds to the second recognition site can be a seed-specific promoter. The seeds can be dicotyledonous seeds or monocotyledonous seeds.

The invention also features an apomictic plant comprising a first nucleic acid comprising a first transcription activator recognition site and a first promoter, the first recognition site and first promoter operably linked to a sequence to be transcribed, a second nucleic acid comprising a second transcription activator recognition site and a second promoter, the second recognition site and second promoter operably linked to a sequence causing seed infertility. The first and second nucleic acids can be a single nucleic acid molecule. The plant can further contain at least one activator nucleic acid encoding at least one transcription activator that binds to at least one of the recognition sites. Each such transcription activator has a promoter operably linked thereto. The plant can be a dicotyledonous plant or a monocotyledonous plant. The sequence to be transcribed can encode a preselected polypeptide that confers herbicide resistance.

Unless otherwise defined, all technical and scientific terms used herein have the same meaning as commonly understood by one of ordinary skill in the art to which this invention belongs. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Other features and advantages of the invention will be apparent from the following detailed description.

BRIEF DESCRIPTION OF TABLES

Tables—Reference Tables

Sequences useful in the instant invention include those described in the Sequence Listing and Reference Tables (sometimes referred to as REF Table).

Reference Tables are found in computer files designated:
Reference_table1__4565.710-0004-55300-US-U-36440.01__1.txt;
Reference_table2__3847.710-0004-55300-US-U-36440.01__1.txt;
Reference_table3__3769.710-0004-55300-US-U-36440.01__1.txt;
Reference_table4__3708.710-0004-55300-US-U-36440.01__1.txt; and
Reference_table5__311987.710-0004-55300-US-U-36440.01__1.txt.

A Reference Table refers to a number of "Maximum Length Sequences" or "MLS." Each MLS corresponds to the longest cDNA and is described in the Av subsection of the Reference Table. The Reference Table includes the following information relating to each MLS:
I. cDNA Sequence
A. 5'UTR
B. Coding Sequence
C. 3'UTR
II. Genomic Sequence
A. Exons
B. Introns
C. Promoters
III. Link of cDNA Sequences to Clone IDs
IV. Multiple Transcription Start Sites
V. Polypeptide Sequences
A. Signal Peptide
B. Domains
C. Related Polypeptides
VI. Related Polynucleotide Sequences
I. cDNA Sequence The Reference Table indicates which sequence in the Sequence Listing represents the sequence of each MLS. The MLS sequence can comprise 5' and 3' UTR as well as coding sequences. In addition, specific cDNA clone numbers also are included in the Reference Table when the MLS sequence relates to a specific cDNA clone.

A. 5'UTR

The location of the 5' UTR can be determined by comparing the most 5' MLS sequence with the corresponding genomic sequence as indicated in the Reference Table. The sequence that matches, beginning at any of the transcriptional start sites and ending at the last nucleotide before any of the translational start sites corresponds to the 5' UTR.

B. Coding Region

The coding region is the sequence in any open reading frame found in the MLS. Coding regions of interest are indicated in the PolyP SEQ subsection of the Reference Table.

C. 3'UTR

The location of the 3' UTR can be determined by comparing the most 3' MLS sequence with the corresponding genomic sequence as indicated in the Reference Table. The sequence that matches, beginning at the translational stop site and ending at the last nucleotide of the MLS corresponds to the 3' UTR.

II. Genomic Sequence

Further, the Reference Table indicates the specific "gi" number of the genomic sequence if the sequence resides in a public databank. For each genomic sequence, Reference tables indicate which regions are included in the MLS. These regions can include the 5' and 3' UTRs as well as the coding sequence of the MLS. See, for example, the scheme below:

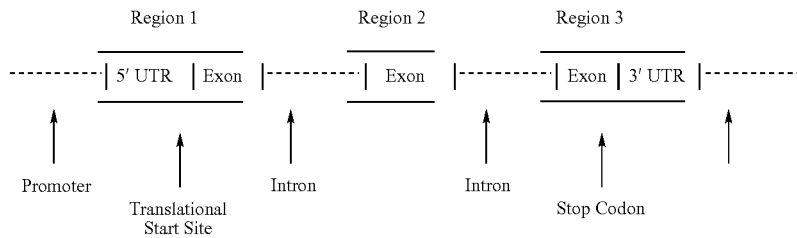

The Reference Table reports the first and last base of each region that are included in an MLS sequence. An example is shown below:
gi No. 47000:
37102 . . . 37497
37593 . . . 37925

The numbers indicate that the MLS contains the following sequences from two regions of gi No. 47000; a first region including bases 37102-37497, and a second region including bases 37593-37925.

A. Exon Sequences

The location of the exons can be determined by comparing the sequence of the regions from the genomic sequences with the corresponding MLS sequence as indicated by the Reference Table.

i. Initial Exon

To determine the location of the initial exon, information from the
(1) polypeptide sequence section;
(2) cDNA polynucleotide section; and
(3) the genomic sequence section
of the Reference Table is used. First, the polypeptide section will indicate where the translational start site is located in the MLS sequence. The MLS sequence can be matched to the genomic sequence that corresponds to the MLS. Based on the match between the MLS and corresponding genomic sequences, the location of the translational start site can be determined in one of the regions of the genomic sequence. The location of this translational start site is the start of the first exon.

Generally, the last base of the exon of the corresponding genomic region, in which the translational start site was located, will represent the end of the initial exon. In some cases, the initial exon will end with a stop codon, when the initial exon is the only exon.

In the case when sequences representing the MLS are in the positive strand of the corresponding genomic sequence, the last base will be a larger number than the first base. When the sequences representing the MLS are in the negative strand of the corresponding genomic sequence, then the last base will be a smaller number than the first base.

ii. Internal Exons

Except for the regions that comprise the 5' and 3' UTRs, initial exon, and terminal exon, the remaining genomic regions that match the MLS sequence are the internal exons. Specifically, the bases defining the boundaries of the remaining regions also define the intron/exon junctions of the internal exons.

iii. Terminal Exon

As with the initial exon, the location of the terminal exon is determined with information from the (1) polypeptide sequence section;
(2) cDNA polynucleotide section; and
(3) the genomic sequence section of the Reference Table. The polypeptide section will indicate where the stop codon is located in the MLS sequence. The MLS sequence can be matched to the corresponding genomic sequence. Based on the match between MLS and corresponding genomic sequences, the location of the stop codon can be determined in one of the regions of the genomic sequence. The location of this stop codon is the end of the terminal exon. Generally, the first base of the exon of the corresponding genomic region that matches the cDNA sequence, in which the stop codon was located, will represent the beginning of the terminal exon. In some cases, the translational start site will represent the start of the terminal exon, which will be the only exon.

In the case when the MLS sequences are in the positive strand of the corresponding genomic sequence, the last base will be a larger number than the first base. When the MLS sequences are in the negative strand of the corresponding genomic sequence, then the last base will be a smaller number than the first base.

B. Intron Sequences

In addition, the introns corresponding to the MLS are defined by identifying the genomic sequence located between the regions where the genomic sequence comprises exons. Thus, introns are defined as starting one base downstream of a genomic region comprising an exon, and end one base upstream from a genomic region comprising an exon.

C. Promoter Sequences

As indicated below, promoter sequences corresponding to the MLS are defined as sequences upstream of the first exon; more usually, as sequences upstream of the first of multiple transcription start sites; even more usually as sequences about 2,000 nucleotides upstream of the first of multiple transcription start sites.

III. Link of cDNA Sequences to Clone IDs

As noted above, the Reference Table identifies the cDNA clone(s) that relate to each MLS. The MLS sequence can be longer than the sequences included in the cDNA clones. In such a case, the Reference Table indicates the region of the MLS that is included in the clone. If either the 5' or 3' termini of the cDNA clone sequence is the same as the MLS sequence, no mention will be made.

IV. Multiple Transcription Start Sites

Initiation of transcription can occur at a number of sites of the gene. The Reference Table indicates the possible multiple transcription sites for each gene. In the Reference Table, the location of the transcription start sites can be either a positive or negative number.

The positions indicated by positive numbers refer to the transcription start sites as located in the MLS sequence. The negative numbers indicate the transcription start site within the genomic sequence that corresponds to the MLS.

To determine the location of the transcription start sites with the negative numbers, the MLS sequence is aligned with the corresponding genomic sequence. In the instances when a public genomic sequence is referenced, the relevant corresponding genomic sequence can be found by direct reference to the nucleotide sequence indicated by the "gi" number shown in the public genomic DNA section of the Reference Table. When the position is a negative number, the transcription start site is located in the corresponding genomic sequence upstream of the base that matches the beginning of the MLS sequence in the alignment. The negative number is relative to the first base of the MLS sequence which matches the genomic sequence corresponding to the relevant "gi" number.

In the instances when no public genomic DNA is referenced, the relevant nucleotide sequence for alignment is the nucleotide sequence associated with the amino acid sequence designated by "gi" number of the later PolyP SEQ subsection.

V. Polypeptide Sequences

The PolyP SEQ subsection lists SEQ ID NOS. and Ceres SEQ ID NO for polypeptide sequences corresponding to the coding sequence of the MLS sequence and the location of the translational start site with the coding sequence of the MLS sequence.

The MLS sequence can have multiple translational start sites and can be capable of producing more than one polypeptide sequence.

Subsection (Dp) provides (where present) information concerning amino acid sequences that are found to be related and have some percentage of sequence identity to the polypeptide sequences of the Reference Tables and Sequence Listing. These related sequences are identified by a "gi" number.

Tables—Protein Group Matrix Tables

In addition to each consensus sequence of the invention, Applicants have generated scoring matrices in Matrix Tables to provide further description of a consensus sequence. The Matrix Tables can be found in computer files:
12514_gly_bra._matrix_table1.txt;
12514._matrix_table2.txt; 12653917._matrix_table3.txt;
23771._matrix_table4.txt; 3000_dico._matrix_table5.txt;
3000._matrix_table6.txt; 1610._matrix_table7.txt;
519._matrix_table8.txt; 8916._matrix_table9.txt;
38419_mono._matrix_table10.txt;
38419._matrix_table11.txt;
38419_dico._matrix_table12.txt;
32791._matrix_table13.txt; 32348._matrix_table14.txt;
5605._matrix_table15.txt;
5605_gly_bra._matrix_table16.txt; and
519gly._matrix_table17.txt. The first row of each matrix indicates the residue position in the consensus sequence. The matrix reports the number of occurrences of all the amino acids that were found in the group members for every residue position of the signature sequence. The matrix also indicates for each residue position, how many different organisms were found to have a polypeptide in the group that included a residue at the relevant position. The last line of the matrix indicates all the amino acids that were found at each position of the consensus. The consensus sequence for each of the above Matrix Tables are in the corresponding Consensus Sequence Table, which contains consensus sequences designated: 12514_gly_bra; 12514; 12653917; 23771; 3000_dico; 3000; 1610; 519; 8916; 38419_mono; 38419; 38419_dico; 32791; 32348; 5605; 5605_gly_bra; and 519_gly.

DETAILED DESCRIPTION

The invention provides novel genetic methods and tools for effectively controlling the transmission of recombinant DNA-based traits from transgenic plants to other cultivars. The invention is based, in part, on the discovery that coordinate expression of certain nucleic acid constructs can control outcrossing and expression of transgenic traits. The method results in the production of infertile seed that carry a gene product for a desired trait. The infertility of the seed prevents unwanted spread of the desired transgenic trait.

Methods for Making Infertile Seed

In one aspect, the invention features a method for making infertile seed. The method comprises permitting seed development to occur on a plurality of first plants that have been pollinated by a plurality of second plants. The first plants can be male-sterile and comprise first and second nucleic acids. The first nucleic acid comprises a first transcription activator recognition site and a first promoter, that are operably linked to a sequence to be transcribed into a desired gene product. The second nucleic acid comprises a second transcription activator recognition site and a second promoter, that are operably linked to a coding sequence causing seed infertility.

The second plants are male-fertile and comprise at least one activator nucleic acid encoding at least one transcription activator and a promoter operably linked thereto. In some embodiments, the transcription activator is effective for binding to both the first and second recognition sites. Upon pollination of the first, male-sterile plants by pollen from the second, male-fertile plants, seed development ensues. The activator nucleic acid carried by the pollen is expressed prior to or during seed development, and the resulting transcription activator activates transcription of the first and the second nucleic acids in developing seeds on the male-sterile female plants. Transcription of the first nucleic acid results in the production of a desired gene product in the resulting seeds, while transcription of the second nucleic acid causes seed infertility. The desired gene product present in the seeds is contained because all, or substantially all, of the seeds are infertile. Thus, unwanted spread of the transgene responsible for the desired trait to the environment, and the desirable trait is effectively contained.

All, or substantially all, of the resulting seeds have a statistically significant increase in the amount of the desired gene product relative to seeds that do not contain or express the first nucleic acid. Seeds made by the method contain the first, the second and the third nucleic acid.

In some embodiments, a single activator nucleic acid encodes two different transcription activators, one of which binds to the first recognition site and the other of which binds to the second recognition site. Alternatively, two different transcription activators can be encoded by separate nucleic acids. In either case, each of the transcription activators can have a different expression pattern, e.g., the transcription activator for the first recognition site can be operably linked to a constitutive promoter and the transcription activator for the second recognition site can be operably linked to a seed-specific promoter. In other embodiments, both transcription activators are operably linked to different, seed-specific promoters.

In some embodiments, the method comprises growing a plurality of plants of an apomictic species. The apomictic plants contain first and second nucleic acids as described above. Typically, the first nucleic acid comprises a first transcription activator recognition site and a first promoter, that are operably linked to a sequence to be transcribed into a desired gene product. The second nucleic acid comprises a second transcription activator recognition site and a second promoter, that are operably linked to a coding sequence causing seed infertility. Such apomictic plants further comprise at least two activator nucleic acids that have different expression patterns. The first activator nucleic acid typically is expressed preferentially in tissues other than seed tissues and floral tissues, whereas the second activator nucleic acid typically is expressed preferentially in seed tissues, e.g., a first transcription activator for the first recognition site is operably linked to a vegetative tissue-specific promoter and a second transcription activator for the second recognition site is operably linked to a seed-specific promoter. In this embodiment, the first transcription activator polypeptide activates transcription of the first nucleic acid, and results in the production of a desired gene product in vegetative tissues, while transcription of the second nucleic acid confers seed infertility. Unwanted spread of the transgene responsible for the desired trait is effectively contained in such apomictic plants.

Desired gene products. Typically, the desired gene product of a sequence to be transcribed is a preselected polypeptide. A preselected polypeptide can be any polypeptide (i.e., 5 or more amino acids joined by a peptide bond). Plants have been used to produce a variety of preselected industrial and pharmaceutical polypeptides, including high value chemicals, modified and specialty oils, enzymes, renewable non-foods such as fuels and plastics, vaccines and antibodies. See e.g., Owen, M. and Pen, J. (eds.), 1996. Transgenic Plants: A Production System for Industrial and Pharmaceutical Proteins. John Wiley & Son Ltd.; Austin, S. et al., 1994. *Annals NY Acad. Sci.* 721:234-242; Austin, S. et al., 1995. *Euphytica* 85: 381-393; Ziegelhoffer, T. et al., 1998. *Molecular Breeding.* U.S. Pat. No. 5,824,779 discloses phytase-protein-pigmenting concentrate derived from green plant juice. U.S. Pat. No. 5,900,525 discloses animal feed compositions containing phytase derived from transgenic alfalfa. U.S. Pat. No. 6,136,320 discloses vaccines produced in transgenic plants. U.S. Pat. No. 6,255,562 discloses insulin. U.S. Pat. No. 5,958,745 discloses the formation of copolymers of 3-hydroxy butyrate and 3-hydroxy valerate. U.S. Pat. No. 5,824,798 discloses starch synthases. U.S. Pat. No. 6,303,341 discloses immunoglobulin receptors. U.S. Pat. No. 6,417,429 discloses immunoglobulin heavy- and light-chain polypeptides. U.S. Pat. No. 6,087,558 discloses the production of proteases in plants. U.S. Pat. No. 6,271,016 discloses an anthranilate synthase gene for tryptophan overproduction in plants.

A preselected polypeptide can be an antibody or antibody fragment. An antibody or antibody fragment includes a humanized or chimeric antibody, a single chain Fv antibody fragment, an Fab fragment, and an F(ab)$_2$ fragment. A chimeric antibody is a molecule in which different portions are derived from different animal species, such as those having a variable region derived from a mouse monoclonal antibody and a human immunoglobulin constant region. Antibody fragments that have a specific binding affinity can be generated by known techniques. Such antibody fragments include, but are not limited to, F(ab')$_2$ fragments that can be produced by pepsin digestion of an antibody molecule, and Fab fragments that can be generated by deducing the disulfide bridges of F(ab')$_2$ fragments. Single chain Fv antibody fragments are formed by linking the heavy and light chain fragments of the Fv region via an amino acid bridge (e.g., 15 to 18 amino acids), resulting in a single chain polypeptide. Single chain Fv antibody fragments can be produced through standard techniques, such as those disclosed in U.S. Pat. No. 4,946,778.

Plant glycans are often non-immunogenic in animals or humans. However, if desired, glycosylation sites can be identified in a preselected polypeptide, and relevant glycosyl transferases can be expressed in parallel with expression of the preselected polypeptide. Alternatively, it may be desirable to prevent glycosylation of a preselected polypeptide, by engineering N-acetylglucosaminyltransferase knock-out plants. If a preselected polypeptide is an antibody or antibody fragment, Asn-X-Ser/Thr sites in the antibody can be deleted.

In some embodiments, the gene product of a sequence to be transcribed is one of the preselected polypeptides in the Table below.

TABLE 1

| | | |
|---|---|---|
| Bromelain | Humatrope ® | Proleukin ® |
| Chymopapain | Humulin ® (insulin) | Protropin ® |
| Papain ® | Infergen ® | Recombivax-HB ® |
| Activase ® | Interferon-gamma-1a | Recormon ® |
| Albutein ® | Interleukin-2 | Remicade ® (s-TNF-r) |
| Angiotensin II | Intron ® | ReoPro ® |
| Asparaginase | Leukine ® (GM-CSF) | Retavase ® (TPA) |
| Avonex ® | Nartogastrim ® | Roferon-A ® |
| Betaseron ® | Neumega ® | Pegaspargas |
| BioTropin ® | Neupogen ® | Prandin ® |
| Cerezyme ® | Norditropin ® | Procrit ® |
| Enbrel ® (s-TNF-r) | Novolin ® (insulin) | Filgastrim ® |
| Engerix-B ® | Nutropin ® | Genotropin ® |
| Epogen ® | Oncaspar ® | Geref ® |
| Sargramostrim | Tripedia ® | Trichosanthin |
| TriHIBit ® | Venoglobin-S ® (HIG) | |

In some embodiments, a sequence to be transcribed results in a desired gene product that is an RNA. Such an RNA, made from a sequence to be transcribed, can be useful for inhibiting expression of an endogenous gene. Suitable DNAs from which such an RNA can be made include an antisense construct and a co-suppression construct. Thus, for example, a sequence to be transcribed can be similar or identical to the sense coding sequence of an endogenous polypeptide, but is transcribed into a mRNA that is unpolyadenylated, lacks a 5' cap structure, or contains an unsplicable intron. Alternatively, a sequence to be transcribed can incorporate a sequence encoding a ribozyme. In another alternative, a sequence to be transcribed can include a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of an endogenous polypeptide, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises an antisense sequence of an endogenous polypeptide, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. See, e.g., WO 99/53050. See, e.g., WO 98/53083; WO 99/32619; WO 98/36083; and WO 99/53050. See also, U.S. Pat. No. 5,034,323. Useful RNA gene products are described in, e.g., U.S. Pat. No. 6,326,527.

In some embodiments, a preselected polypeptide is a polypeptide that confers herbicide resistance on plants expressing the polypeptide. Herbicide resistance is also sometimes referred to as herbicide tolerance. Polypeptides conferring resistance to a herbicide that inhibits the growing point or meristem, such as an imidazolinone or a sulfonylurea can be suitable. Exemplary polypeptides in this category code for mutant ALS and AHAS enzymes as described, for example, in U.S. Pat. Nos. 5,767,366 and 5,928,937. U.S. Pat. Nos. 4,761,373 and 5,013,659 are directed to plants resistant to various imidazolinone or sulfonamide herbicides. U.S. Pat. No. 4,975,374 relates to plant cells and plants containing a gene encoding a mutant glutamine synthetase (GS) resistant to inhibition by herbicides that are known to inhibit GS, e.g. phosphinothricin and methionine sulfoximine. U.S. Pat. No. 5,162,602 discloses plants resistant to inhibition by cyclohexanedione and aryloxyphenoxypropanoic acid herbicides. The resistance is conferred by an altered acetyl coenzyme A carboxylase(ACCase).

Polypeptides for resistance to glyphosate (sold under the trade name Roundup®) are also suitable. See, for example, U.S. Pat. Nos. 4,940,835 and 4,769,061. U.S. Pat. No. 5,554,798 discloses transgenic glyphosate resistant maize plants, in which resistance is conferred by an altered 5-enolpyruvyl-3-phosphoshikimate (EPSP) synthase. Such polypeptides can confer resistance to glyphosate herbicidal compositions, including without limitation glyphosate salts such as the trimethylsulphonium salt, the isopropylamine salt, the sodium salt, the potassium salt and the ammonium salt. See, e.g., U.S. Pat. Nos. 6,451,735 and 6,451,732.

Polypeptides for resistance to phosphono compounds such as glufosinate ammonium or phosphinothricin, and pyridinoxy or phenoxy propionic acids and cyclohexones are also suitable. See European application No. 0 242 246. See also, U.S. Pat. Nos. 5,879,903, 5,276,268 and 5,561,236.

Other herbicides include those that inhibit photosynthesis, such as a triazine and a benzonitrile (nitrilase). See U.S. Pat. No. 4,810,648. Other herbicides include 2,2-dichloropropionic acid, sethoxydim, haloxyfop, imidazolinone herbicides, sulfonylurea herbicides, triazolopyrimidine herbicides, s-triazine herbicides and bromoxynil. Also suitable are herbicides that confer resistance to a protox enzyme. See, e.g., U.S. Patent Application No. 20010016956, and U.S. Pat. No. 6,084,155.

It will be recognized that more than one sequence to be transcribed can be present in some embodiments. For example, coding sequences for two preselected polypeptides may be present on the same or different nucleic acids, and encode polypeptides useful for manipulating a biosynthetic pathway. Alternatively, two coding sequences may be present and encode polypeptides found in a single protein, e.g., a heavy-chain immunoglobulin polypeptide and a light-chain immunoglobulin polypeptide, respectively.

Sequence causing seed infertility. A nucleic acid that results in seed infertility can encode a polypeptide, e.g., a polypeptide involved in seed development, or can form a transcription product. Overexpression or timely expression of such a nucleic acid results in the production of infertile seeds, i.e., seeds that are incapable of producing offspring. In some embodiments, infertile seeds do not germinate. In other embodiments, infertile seeds germinate and form seedlings that do not mature, e.g., seedlings that die before reaching maturity. In yet other embodiments, infertile seeds germinate and form mature plants that are incapable of forming seeds, e.g., that produce no floral structures or abnormal floral structures, or that cannot form gametes.

The product of a nucleic acid that results in seed infertility, i.e., a seed infertility factor, can be an agonist of a polypeptide involved in seed development. Such agonists can be polypeptides (e.g., dominant loss-of-function mutants), and also can be nucleic acids (e.g., antisense nucleic acids, ribozymes, or double-stranded RNA). Those skilled in the art can construct dominant loss of function mutants or nucleic acids using routine methods. Disruption of the function of polypeptides involved in seed development can result in the production of infertile seeds. Polypeptides involved in seed development can be identified, for example, by review of the scientific literature for reports of such polypeptides, by identifying orthologs of polypeptides reportedly involved in seed development, and by genetic screening. Certain nucleic acids suitable for use in conferring seed infertility are described in the Sequence Listing and Reference Tables. See also Table 2 below, which lists clone IDs for some such nucleic acids. Orthologs of these nucleic acids are found in the Ortholog Table in the computer file designated ortholog.txt.

TABLE 2

| Clone ID |
|---|
| clone 32791 |
| clone 332 |
| clone 519 |
| clone 23771 |
| clone 3000 |
| clone 32791 |
| clone 32348 |
| clone 12514 |
| clone 1610 |
| clone 248859 |
| clone 3858 |
| clone 8916 |
| clone 38419 |
| clone 5605 |
| cDNA 1821568 |

An exemplary polypeptide involved in seed development is the FIE polypeptide, which suppresses endosperm development until fertilization occurs. See, U.S. Pat. No. 6,229,064. Seeds that inherit a mutant Fie allele are reported to abort, even if the paternal allele is normal. See, Yadegari, R. et al., Plant Cell 12:2367-81 (2000); U.S. Pat. No. 6,093,874. Other polypeptides for which suppression of expression can cause seed infertility include the products of the DMT and MEA genes. Another exemplary polypeptide involved in seed development is AP2, which is reportedly required for normal seed development. See, U.S. Pat. No. 6,093,874. Two other exemplary polypeptides involved in seed development are INO and ANT, which reportedly are required for ovule integument development. Mutations in INO and ANT reportedly can affect ovule development, resulting in incomplete megasporogenesis. See, WO 00/40694. Thus, transgenes encoding dominant negative suppression polypeptides, or transgenes producing antisense, ribozyme or double stranded RNA gene products can cause seed infertility.

Another exemplary polypeptide involved in seed development is the polypeptide encoded by the LEC2 gene. LEC2 and LEC2-orthologous polypeptides are transcription factors that typically possess a DNA binding domain termed the B3 domain. See, e.g., amino acid residues 165 to 277 in SEQ ID NO:2 of U.S. Pat. No. 6,492,577. A B3 domain can be found in other transcription factors including VIVIPAROUS1, AUXIN RESPONSE FACTOR 1, FUSCA3 and ABI3. Mutations in the LEC2 polypeptide are thought to cause defects in the late seed maturation phase of embryo development.

Another polypeptide involved in seed development is a HAP3-type CCAAT-box binding factor (CBF) subunit. A CBF complex is a heteromeric complex that binds a promoter element having a CCAAT nucleotide sequence motif, often found in the 5' region of eukaryotic genes. CBF complexes bind the CCAAT motif in a wide variety of organisms. CBF complexes include at least two subunits that are involved in binding DNA, as well as one or more subunits that have transcription activation activity. The HAP3-type CBF subunits listed in Table 3 are homologous to the Arabidopsis thaliana HAP3 subunit having GI accession number 3282674. This particular HAP3 type CBF subunit is encoded by the Arabidopsis LEAFY COTYLEDONI (LEC1) gene, which is reportedly required for the specification of cotyledon identity and the completion of embryo maturation. See, e.g., U.S. Pat. Nos. 6,320,102 and 6,235,974. The LEC1 gene reportedly functions at an early developmental stage to maintain embryonic cell fate. LEC1 RNA accumulates during seed development in embryo cell types and in endosperm tissue. Ectopic postembryonic expression of the LEC1 gene in vegetative cells induces the expression of embryo-specific genes and initiates formation of embryo-like structures. Thus LEC1 appears to be an important regulator of embryo development that activates the transcription of genes required for both embryo morphogenesis and cellular differentiation. Also indicative of LEC1's role in seed maturation are the observations that lec1 mutant seed have altered morphology. For example, during seed development the shoot meristem is activated prematurely. Moreover, the embryo does not synthesize seed storage proteins. Finally lec1 seed are desiccation intolerant and die during late embryogenesis. LEC1 CBF subunits can be distinguished from other HAP3-type subunits on the basis of at least one diagnostic conserved sequence. See e.g., WO 99/67405 and WO/00/28058.

TABLE 3

CBF HAP3-TYPE SUBUNITS

| GI Accession Number | Brief Description |
|---|---|
| 3282674 | CCAAT-box binding factor HAP3 homolog [Arabidopsis thaliana] |
| 6552738 | [Arabidopsis thaliana] |
| 9758795 | Contains similarity to CCAAT-box-binding transcription factor~gene__id:MNJ7.26 [Arabidopsis thaliana] |
| 7443520 | Transcription factor, CCAAT-binding, chain A - Arabidopsis thaliana |
| 2398529 | Transcription factor [Arabidopsis thaliana] |
| 9758792 | Contains similarity to CCAAT-box-binding transcription factor~gene__id:MNJ7.23 [Arabidopsis thaliana] |
| 11358889 | Transcription factor NF-Y, CCAAT-binding-like protein - Arabidopsis thaliana |
| 4371295 | Putative CCAAT-box-binding transcription factor [Arabidopsis thaliana] |
| 2398527 | Transcription factor [Arabidopsis thaliana] |
| 115840 | CBFA__MAIZE CCAAT-BINDING TRANSCRIPTION FACTOR SUBUNIT A (CBF-A) |
| 22380 | CAAT-box DNA binding protein subunit B (NF-YB) [Zea mays] |
| 4558662 | Putative CCAAT-box-binding transcription factor [Arabidopsis thaliana] |
| 3928076 | Putative CCAAT-box-binding transcription factor subunit [Arabidopsis thaliana] |
| 203355 | CCAAT binding transcription factor-B subunit [Rattus norvegicus] |
| 104551 | Transcription factor NF-Y, CAAT-binding, chain B - chicken |
| 2133270 | Transcription factor HAP3 - Emericella nidulans |
| 3170225 | Nuclear Y/CCAAT-box binding factor B subunit NF-YB |

TABLE 3-continued

CBF HAP3-TYPE SUBUNITS

| GI Accession Number | Brief Description |
|---|---|
| | [*Xenopus laevis*] |
| 115842 | CBFA_PETMA CCAAT-BINDING TRANSCRIPTION FACTOR SUBUNIT A (CBF-A) |
| 13648093 | Nuclear transcription factor Y, beta [*Homo sapiens*] |
| 3738293 | Putative CCAAT-box-binding transcription factor [*Arabidopsis thaliana*] |
| 115838 | CBFA_CHICK CCAAT-BINDING TRANSCRIPTION FACTOR SUBUNIT A (CBF-A) |
| 115840 | CBFA_MAIZE CCAAT-BINDING TRANSCRIPTION FACTOR SUBUNIT A (CBF-A) |
| 22380 | CAAT-box DNA binding protein subunit B (NF-YB) [*Zea mays*] |
| 4558662 | Putative CCAAT-box-binding transcription factor [*Arabidopsis thaliana*] |
| 3928076 | Putative CCAAT-box-binding transcription factor subunit [*Arabidopsis thaliana*] |
| 203355 | CCAAT binding transcription factor-B subunit [*Rattus norvegicus*] |
| 104551 | Transcription factor NF-Y, CAAT-binding, chain B - chicken |
| 2133270 | Transcription factor HAP3 - *Emericella nidulans* |
| 3170225 | Nuclear Y/CCAAT-box binding factor B subunit NF-YB [*Xenopus laevis*] |
| 115842 | CBFA_PETMA CCAAT-BINDING TRANSCRIPTION FACTOR SUBUNIT A (CBF-A) |
| 13648093 | Nuclear transcription factor Y, beta [*Homo sapiens*] |
| 3738293 | Putative CCAAT-box-binding transcription factor [*Arabidopsis thaliana*] |
| 115838 | CBFA_CHICK CCAAT-BINDING TRANSCRIPTION FACTOR SUBUNIT A (CBF-A) |

Other HAP3-type CBF polypeptides can be identified by homologous nucleotide and polypeptide sequence analyses. Known HAP3-type CBF subunits in one organism can be used to identify homologous subunits in another organism. For example, performing a query on a database of nucleotide or polypeptide sequences can identify homologs of a subunit of a known HAP3-type CBF complex. Homologous sequence analysis can involve BLAST or PSI-BLAST analysis of non-redundant databases using known HAP3-type CBF subunit amino acid sequences. Those proteins in the database that have greater than 40% sequence identity are candidates for further evaluation for suitability as a seed infertility factor polypeptide. If desired, manual inspection of such candidates can be carried out in order to narrow the number of candidates that may be further evaluated. Manual inspection is performed by selecting those candidates that appear to have domains suspected of being present in subunits of HAP3-type CBF complexes.

A percent identity for any subject nucleic acid or amino acid sequence relative to another "target" nucleic acid or amino acid sequence can be determined. For example, conserved regions of polypeptides can be determined by aligning sequences of the same or related polypeptides from closely related plant species. Closely related plant species preferably are from the same family. Alternatively, alignments are performed using sequences from plant species that are all monocots or are all dicots. In some embodiments, alignment of sequences from two different plant species adequate, e.g., sequences from canola and *Arabidopsis* can be used to identify one or more conserved regions.

Typically, polypeptides that exhibit at least about 35% amino acid sequence identity are useful to identify conserved regions in polypeptides. Conserved regions of related proteins sometimes exhibit at least 50% amino acid sequence identity; or at least about 60%; or at least 70%, at least 80%, or at least 90% amino acid sequence identity. In some embodiments, a conserved region of target and template polypeptides exhibit at least 92, 94, 96, 98, or 99% amino acid sequence identity. Amino acid sequence identity can be deduced from amino acid or nucleotide sequence.

Highly conserved domains have been identified within HAP3-type CBF subunits. These conserved regions can be useful in identifying HAP3-type CBF subunits. The primary amino acid sequences of HAP3-type CBF subunits indicate the presence of TATA-box-binding protein association domains as well as histone fold motifs, which are important for protein dimerization. A conserved HAP 3 region derived from this sequence alignment can be represented as follows:

+EQD<2>(L,M)P(I,V)AN(V,I)<1>+IM+<2>aP<2>(A,G)

K(I,V)t(D,K)(D,E)(A,S)K(E,D)<1>aQECVSErISF(I,V)

(T,S)tE(A,L)<1>n+C(Q,H)<1>E(Q,K)RKT(I,V)(T,N)

tnDa<2>Aa<2>LGFn<1>Y<3>L<2>ra<1>+rR, where

| | | | |
|---|---|---|---|
| + | = | "positive" | e.g. H,K,R |
| a | = | "Aliphatic" | e.g. I,L,V,M |
| t | = | "Tiny" | e.g. T,G,A |
| r | = | "Aromatic" | e.g. F,Y,W |
| n | = | "Negative" | e.g. E,D |
| p | = | "Polar" | e.g. N,Q |
| <#> | = | specified # of amino acids, any type | |
| (X,Y) | = | one amino acid, e.g. either X or Y | |

Transcription activators. A transcription activator is a polypeptide that binds to a recognition site on DNA, resulting in an increase in the level of transcription from a promoter operably linked in cis with the recognition site. Many transcription activators have discrete DNA binding and transcription activation domains. The DNA binding domain(s) and transcription activation domain(s) of transcription activators can be synthetic or can be derived from different sources (e.g., two-component system or chimeric transcription activators). In some embodiments, a two-component system transcription activator has a DNA binding domain derived from the yeast gal4 gene and a transcription activation domain derived from the VP16 gene of herpes simplex virus. In other embodiments, a two-component system transcription activator has a DNA binding domain derived from a yeast HAP1 gene and the transcription activation domain derived from VP16. Populations of transgenic organisms or cells having a first nucleic acid construct that encodes a chimeric polypeptide and a second nucleic acid construct that encodes a transcription activator polypeptide can be produced by transformation, transfection, or genetic crossing. See, e.g., WO 97/31064.

Nucleic acid expression. For expression of a sequence to be transcribed, seed infertility factor (polypeptide or nucleic acid agonist), or transcription activator, a coding sequence of the invention is operably linked to a promoter and, optionally, a recognition site for a transcription activator. As used herein, the term "operably linked" refers to positioning of a regulatory element in a nucleic acid relative to a coding sequence so as to allow or facilitate transcription of the coding sequence. For example, a recognition site for a transcription activator is positioned with respect to a promoter so that upon binding of the transcription activator to the recognition site, the level of transcription from the promoter is increased. The position of the recognition site relative to the promoter can be varied for different transcription activators, in order to achieve the desired increase in the level of transcription. Selection and positioning of promoter and transcription activator recognition site is affected by several factors, including, but not limited to, desired expression level, cell or tissue specificity, and inducibility. It is a routine matter for one of skill in the art to modulate the expression of a coding sequence by appropriately selecting and positioning promoters and recognition sites for transcription activators.

A promoter suitable for being operably linked to a transcription activator nucleic acid typically has greater expression in endosperm or embryo, and lower expression in other plant tissues. Such a promoter permits expression of the transcription during seed development, and thus, expression of a sequence to be transcribed during seed development.

A promoter suitable for being operably linked to a sequence to be transcribed can, if desired, have greater expression in one or more tissues of a developing embryo or developing endosperm. For example, such a promoter can have greater expression in the aleurone layer, parts of the endosperm such as chalazal endosperm. Expression typically occurs throughout development. If a sequence to be transcribed is targeted to endosperm and encodes a polypeptide, accumulation of the product can be facilitated by fusing certain amino acid sequences to the amino- or carboxy-terminus of the polypeptide. Such amino acid sequences include KDEL and HDEL, which facilitate targeting of the polypeptide to the endoplasmic reticulum. A histone can be fused to the polypeptide, which facilitates targeting of the polypeptide to the nucleus. Extensin can be fused to the polypeptide, which facilitates targeting to the cell wall. A seed storage protein can be f used to the polypeptide, which facilitates targeting to protein bodies in the endosperm or cotyledons.

Some suitable promoters initiate transcription only, or predominantly, in certain cell types. For example, a promoter specific to a reproductive tissue (e.g., fruit, ovule, seed, pollen, pistils, female gametophyte, egg cell, central cell, nucellus, suspensor, synergid cell, flowers, embryonic tissue, embryo, zygote, endosperm, integument, seed coat or pollen) is used. A cell type or tissue-specific promoter may drive expression of operably linked sequences in tissues other than the target tissue. Thus, as used herein a cell type or tissue-specific promoter is one that drives expression preferentially in the target tissue, but may also lead to some expression in other cell types or tissues as well. Methods for identifying and characterizing promoter regions in plant genomic DNA include, for example, those described in the following references: Jordano, et al., Plant Cell, 1:855-866 (1989); Bustos, et al., Plant Cell, 1:839-854 (1989); Green, et al., EMBO J. 7, 4035-4044 (1988); Meier, et al., Plant Cell, 3, 309-316 (1991); and Zhang, et al., Plant Physiology 110: 1069-1079 (1996).

Exemplary reproductive tissue promoters include those derived from the following seed-genes: zygote and embryo LEC1; suspensor G564; maize MAC1 (see, Sheridan (1996) Genetics 142:1009-1020); maize Cat3, (see, GenBank No. L05934, Abler (1993) Plant Mol. Biol. 22:10131-1038); *Arabidopsis* viviparous-1, (see, Genbank No. U93215); *Arabidopsis* atmycl, (see, Urao (1996) Plant Mol. Biol. 32:571-57, Conceicao (1994) Plant 5:493-505); *Brassica napus* napin gene family, including napA, (see, GenBank No. J02798, Josefsson (1987) JBL 26:12196-1301, Sjodahl (1995) Planta 197:264-271). The ovule-specific promoters FBP7 and DEFH9 are also suitable promoters. Colombo, et al. (1997) Plant Cell 9:703-715; Rotino, et al. (1997) Nat. Biotechnol. 15:1398-1401. The nucellus-specific promoter described in Cehn and Foolad (1997) Plant Mol. Biol. 35:821-831, is also suitable. Early meiosis-specific promoters are also useful. See, Kobayshi et al., (1994) DNA Res. 1:15-26; Ji and Landgridge (1994) Mol. Gen. Genet. 243:17-23. Other meiosis-related promoters include the MMC-specific DMC1 promoter and the SYN1 promoter. See, Klimyuk and Jones (1997) Plant J. 11:1-14; Bai et al. (1999) Plant Cell 11:417-430. Other exemplary reproductive tissue-specific promoters include those derived from the pollen genes described in, for example: Guerrero (1990) Mol. Gen. Genet. 224:161-168; Wakeley (1998) Plant Mol. Biol. 37:187-192; Ficker (1998) Mol. Gen. Genet. 257:132-142; Kulikauskas (1997) Plant Mol. Biol. 34:809-814; and Treacy (1997) Plant Mol. Biol. 34:603-611). Yet other suitable reproductive tissue promoters include those derived from the following embryo genes: *Brassica napus* 2s storage protein (see, Dasgupta (1993) Gene 133:301-302); *Arabidopsis* 2s storage protein; soybean b-conglycinin; *Brassica napus* oleosin 20 kD gene (see, GenBank No. M63985); soybean oleosin A (see, Genbank No. U09118); soybean oleosin B (see, GenBank No. U09119); *Arabidopsis* oleosin (see, GenBank No. Z17657); maize oleosin 18 kD (see, GenBank No. J05212; Lee (1994) Plant Mol. Biol. 26:1981-1987; and the gene encoding low molecular weight sulfur rich protein from soybean, (see, Choi (1995) Mol. Gen, Genet. 246:266-268). Yet other exemplary reproductive tissue promoters include those derived from the following genes: ovule BELL (see Reiser (1995) Cell 83:735-742; Ray (1994) Proc. Natl. Acad. Sci. USA 91:5761-5765; GenBank No. U39944); central cell FIE1; flower primordia *Arabidopsis* APETALA1 (AP1) (see, Gustafson-Brown (1994) Cell 76:131-143; Mandrel (1992) Nature 360:273-277); flower *Arabidopsis* AP2 (see, Drews (1991) Cell 65:991-1002; Bowman (1991) Plant Cell 3:749-758); *Arabidopsis* flower ufo, expressed at the junction between sepal and petal primordia (see, Bossinger (1996) Development 122: 1093-1102); fruit-specific tomato E8; a tomato gene expressed during fruit ripening, senescence and abscission of leaves and flowers (Blume (1997) Plant J. 12:731-746); and pistil-specific potato SK2 (Ficker (1997) Plant Mol. Biol. 35:425-431). See also, WO 98/08961; WO 98/28431; WO 98/36090; U.S. Pat. No. 5,907,082; U.S. Pat. Nos. 6,320,102; 6,235,975; and WO 00/24914. Suitable promoters also include those that are inducible, e.g., by tetracycline (Gatz, 1997), steroids (Aoyama and Chua, 1997), and ethanol (Slater et al. 1998, Caddick et al., 1998).

Nucleic acids. A nucleic acid for use in the invention may be obtained by, for example, DNA synthesis or the polymerase chain reaction (PCR). PCR refers to a procedure or technique in which target nucleic acids are amplified. PCR can be used to amplify specific sequences from DNA as well as RNA, including sequences from total genomic DNA or total cellular RNA. Various PCR methods are described, for example, in PCR Primer: A Laboratory Manual, Dieffenbach, C. & Dveksler, G., Eds., Cold Spring Harbor Laboratory Press, 1995. Generally, sequence information from the ends of the region of interest or beyond is employed to design oligonucleotide primers that are identical or similar in sequence to opposite strands of the template to be amplified. Various PCR strategies are available by which site-specific nucleotide sequence modifications can be introduced into a template nucleic acid.

Nucleic acids for use in the invention may be detected by techniques such as ethidium bromide staining of agarose gels, Southern or Northern blot hybridization, PCR or in situ hybridizations. Hybridization typically involves Southern or Northern blotting. See e.g., Sambrook et al., 1989, Molecular Cloning: A Laboratory Manual, $2^{nd}$ Edition, Cold Spring Harbor Press, Plainview, N.Y., sections 9.37-9.52. Probes should hybridize under high stringency conditions to a nucleic acid or the complement thereof. High stringency conditions can include the use of low ionic strength and high temperature washes, for example 0.015 M NaCl/0.0015 M sodium citrate (0.1×SSC), 0.1% sodium dodecyl sulfate (SDS) at 65° C. In addition, denaturing agents, such as formamide, can be employed during high stringency hybridization, e.g., 50% formamide with 0.1% bovine serum albumin/ 0.1% Ficoll/0.1% polyvinylpyrrolidone/50 mM sodium phosphate buffer at pH 6.5 with 750 mM NaCl, 75 mM sodium citrate at 42° C.

Methods for Making a Polypeptide

In another aspect, the invention features a method for making a polypeptide. The method involves obtaining seed produced as described herein. Such seed are infertile and can be identified by, e.g., the presence of at least the three nucleic acids described above. In some embodiments, there are two transcription activators present in male-fertile plants and, therefore, four nucleic acids, as described above. In some embodiments, a practitioner can obtain seed of the invention by harvesting seeds from both male-sterile and male-fertile plants, or harvesting seeds solely from the male-sterile plants. The choice depends upon, inter alia, whether the two types of parent plants are planted in rows or are randomly interplanted. However, either type of harvesting is encompassed by the invention. In some embodiments, seeds are obtained by purchasing them from a grower. In some embodiments, a practitioner permits male-fertile plants to pollinate male-sterile plants prior to harvesting.

The method also involves extracting the preselected polypeptide, or an endogenous polypeptide, from the seed. Typically, such seeds have a statistically significant increase in the amount of the preselected polypeptide relative to seeds that do not contain or express the first nucleic acid. The choice of techniques to be used for carrying out extraction of a preselected polypeptide will depend on the nature of the polypeptide. For example, if the preselected polypeptide is an antibody, non-denaturing purification techniques may be used. On the other hand, if the preselected polypeptide is a high methionine zein, denaturing techniques may be used. The degree of purification can be adjusted as desired, depending on the nature of the preselected or endogenous polypeptide. For example, an animal feed having an increased amount of an endogenous polypeptide may have no purification, whereas a preselected antibody polypeptide may have extensive purification.

Plants and Seeds

Plants Techniques for introducing exogenous nucleic acids into monocotyledonous and dicotyledonous plants are known in the art, and include, without limitation, *Agrobacterium*-mediated transformation, viral vector-mediated transformation, electroporation and particle gun transformation, e.g., U.S. Pat. Nos. 5,538,880, 5,204,253, 5,591,616, and 6,329,571. If a cell or tissue culture is used as the recipient tissue for transformation, plants can be regenerated from transformed cultures by techniques known to those skilled in the art. Transgenic plants can be entered into a breeding program, e.g., to introduce a nucleic acid into other lines, to transfer a nucleic acid to other species or for further selection of other desirable traits. Alternatively, transgenic plants can be propagated vegetatively for those species amenable to such techniques. Progeny includes descendants of a particular plant or plant line. Progeny of an instant plant include seeds formed on $F_1$, $F_2$, $F_3$, and subsequent generation plants, or seeds formed on $BC_1$, $BC_2$, $BC_3$, and subsequent generation plants. Seeds produced by a transgenic plant can be grown and then selfed (or outcrossed and selfed) to obtain seeds homozygous for the nucleic acid encoding a novel polypeptide.

A suitable group of plants with which to practice the invention include dicots, such as safflower, alfalfa, soybean, rapeseed (high erucic acid and canola), or sunflower. Also suitable are monocots such as corn, wheat, rye, barley, oat, rice, millet, amaranth, sorghum, Kentucky bluegrass, bluestems, weeping lovegrass, or fescues. Also suitable are vegetable crops or root crops such as broccoli, peas, sweet corn, popcorn, tomato, beans (including kidney beans, lima beans, dry beans, green beans) and the like. Also suitable are fruit crops such as peach, pear, apple, cherry, orange, lemon, grapefruit, plum, mango and palm. Thus, the invention has use over a broad range of plants, including species from the genera *Anacardium, Arachis, Asparagus, Atropa, Avena, Bothriochloa, Brassica, Citrus, Citrullus, Capsicum, Carthamus, Cocos, Coffea, Cucumis, Cucurbita, Daucus, Dichanthium, Elaeis, Eragrostis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panicum, Pannesetum, Persea, Phaseolus, Pinus, Pistachia, Pisum, Pyrus, Poa, Prunus, Raphanus, Ricinus, Secale, Senecio, Sinapis, Solanum, Sorghum, Theobromus, Trigonella, Triticum, Vicia, Vitis, Vigna* and *Zea*.

Plants of the first type can be male-sterile, e.g., pollen is either not formed or is nonviable. Suitable male-sterility systems are known, including cytoplasmic male sterility (CMS), nuclear male sterility, genetic male sterility, and molecular male sterility wherein a transgene inhibits microsporogenesis and/or pollen formation. Female parent plants containing CMS are particularly useful. In the case of *Brassica* species, CMS can be, for example of the ogu, nap, pol, mur, or tour type. See, e.g., U.S. Pat. Nos. 6,399,856, 6,262,341; 6,262,334; 6,392,119 and 6,255,564. In the case of corn, a number of different methods of conferring male sterility are available, such as multiple mutant genes at separate locations within the genome that confer male sterility. In addition, one can use transgenes to silence one or more nucleic acid sequences necessary for male fertility. See, U.S. Pat. Nos. 4,654,465, 4,727,219, and 5,432,068. See also, EPO publication no. 329, 308 and PCT application WO 90/08828.

Alternatively, plants of both the first type and the second type can be male-fertile. In this case, plants of the first type can be pollinated by hand, using pollen from plants of the second type. In some embodiments, pollen-forming structures on plants of the first type are removed in order to prevent self-pollination of first plants, thereby permitting manual or natural pollination by pollen from second plants. One can also use gametocides to inhibit or prevent pollen formation on plants of the first type. Gametocides are chemicals that affect cells critical to male fertility. Typically, a gametocide affects fertility only in the plants to which the gametocide is applied. Application of the gametocide, timing of the application and genotype can affect the usefulness of the approach. See, U.S. Pat. No. 4,936,904. In some embodiments, plants are of a species that exhibits partial or complete self-incompatibility, e.g., alfalfa, *Brassica rapa*, or potato. When complete self-incompatibility is present, measures such as male sterility systems or removal of pollen-forming structures on plants of the first type may not be necessary.

Articles of Manufacture

A plant seed composition of the invention can contain seeds of the first type of plant and of the second type of plant.

Seeds of the first type of plant typically are of a single variety, as are seeds of the second type of plant.

The proportion of seeds of each type of plant in a composition is measured as the number of seeds of a particular type divided by the total number of seeds in the composition, and can be formulated as desired to meet requirements based on geographic location, pollen quantity, pollen dispersal range, plant maturity, choice of herbicide, and the like. The proportion of the first variety can be from about 70 percent to about 99.9 percent, e.g., 90%, 91%, 92%, 93%, 94%, 95%, 96%, 97%, 98%, or 99%. The proportion of the second type can be from about 0.1 percent to about 30 percent, e.g., 0.5%, 1%, 2%, 5%, 10%, 15%, or 30%. When large quantities of a seed composition are formulated, or when the same composition is formulated repeatedly, there may be some variation in the proportion of each type observed in a sample of the composition, due to sampling error. In the present invention, such sampling error typically is about ±5% of the expected proportion, e.g., 90%±4.5%, or 5%±0.25%.

For example, a seed composition of the invention can be made from two corn varieties. A first corn variety can constitute 92% of the seeds in the composition and be male-sterile, and carry a first nucleic acid encoding one or more polypeptides involved in the synthesis of poly(3-hydroxybutyrate-co-3-hydroxyvalerate. A second corn variety can constitute 8% of the seed in the composition and be male-fertile, and carry a third nucleic acid encoding a transcription activator that recognizes a transcription recognition site operably linked to a nucleic acid encoding a preselected polypeptide. Thus, such a seed composition can be used to grow plants that are suitable for practicing a method of the invention.

Typically, a substantially uniform mixture of seeds of each of the types is conditioned and bagged in packaging material by means known in the art to form an article of manufacture. Such a bag of seed preferably has a package label accompanying the bag, e.g., a tag or label secured to the packaging material, a label printed on the packaging material or a label inserted within the bag. The package label indicates that the seeds therein are a mixture of varieties, e.g., two different varieties. The package label may indicate that plants grown from such seeds are suitable for making an indicated preselected polypeptide. The package label also may indicate the seed mixture contained therein incorporate transgenes that provide biological containment of the transgene encoding the preselected polypeptide.

Plants grown from the varieties in a seed composition of the invention typically have the same or very similar maturity, i.e., the same or very similar number of days from germination to crop seed maturation. In some embodiments, however, one or more varieties in a seed composition of the invention can have a different relative maturity compared to other varieties in the composition. For example, the first type of plants grown from a seed composition can be classified as having a 105 day relative maturity, while the second type of plants grown from the seed composition can be classified as having a 110 day relative maturity. The presence of plants of different relative maturities in a seed composition can be useful as desired to properly coordinate optimum pollen receptivity of the first type of plants with optimum pollen shed from the second type of plants. Relative maturity of a variety of a given crop species is classified by techniques known in the art.

In some embodiments, a plant seed composition of the invention comprises seeds of an apomictic plant species. Seeds of an apomictic species in such a composition constitute at least about 90% of the seeds in the composition, e.g., at least 91%, 93%, 95%, 97% or 99%. Typically the apomictic seeds are of a single variety. Apomictic plant species include facultative apomicts such as weeping lovegrass, Kentucky bluegrass, or bluestems, as well as obligate apomicts. Apomictic mechanisms in seeds of the composition can be classified as aposporous or diplosporous, primarily in grasses, or adventitious embryony, found in citrus. Seeds of an apomictic plant species in such a composition contain nucleic acid constructs as discussed herein, and can be germinated and grown to form plants whose seeds are infertile. The infertility of the seed prevents unwanted spread of a desired transgenic trait present in such plants to other plants of the same species.

The invention is further described in the following examples, which do not limit the scope of the invention described in the claims.

EXAMPLES

Example 1

Chimeric LEC2 Nucleic Acid Construct

A chimeric LEC2 gene construct, designated pLEC2, was made using standard molecular biology techniques. The construct contains the coding sequence for the *Arabidopsis* LEC2 polypeptide. pLEC2 contains 5 binding sites for the DNA binding domain upstream activation sequence of the Hap1 transcription factor ($UAS_{Hap1}$) located 5' to and operably linked to a CaMV35S minimal promoter. The CaMV35S minimal promoter is located 5' to and operably linked to the LEC2 coding sequence. The construct contains an OCS polyA transcription terminator sequence operably linked to the 3' end of the LEC2 coding sequence. The binding of a transcription factor that possesses a Hap 1 DNA binding domain to the $UAS_{Hap1}$ is necessary for transcriptional activation of the LEC2 chimeric gene.

Example 2

Transgenic Rice Plants

The pLEC2 plasmid was introduced into the Japonica rice cultivar Kitaake by *Agrobacterium tumefaciens* mediated transformation using techniques similar to those described in U.S. Pat. No. 6,329,571. Transformants were selected based on resistance to the herbicide bialophos, conferred by a bar gene present on the introduced nucleic acid. After selfing to homozygosity for 3 generations, several transformed plants, designated pLEC2-3-11-10, pLEC2-3-11-12, pLEC2-3-11-13, pLEC2-3-12-2, pLEC2-3-12-4, were selected for further study.

A construct designated pCR19, containing a chimeric Hap1-VP16 gene and a green fluorescent protein (GFP) reporter gene was introduced into the Kitaake cultivar by the same technique. The chimeric Hap1-VP16 gene contained a rice ubiquitin minimal promoter operably linked to the 5' end of the Hap 1-VP16 coding sequence and an NOS polyA terminator operably linked to the 3' end of the Hap1-VP16 coding sequence. The amino acid sequence of the HAP1 portion of the Hap 1-VP16 transcription activator is that of the yeast Hap1 gene. The GFP reporter gene included 5 copies of a $UAS_{HAP1}$ upstream activator sequence element operably linked 5' to the GFP coding sequence and an OCS polyA terminator operably linked 3' to the GFP coding sequence.

Transformants were selected based on bialophos resistance conferred by a bar gene, and then screened for plants in which expression of GFP was targeted to the embryo. After selfing for 2 generations and verifying embryo-specific expression of the Hap1-VP16 coding sequence, 2 heterozygous transformed plants, designated CR19-60-1 and CR19-60-2, were selected for further study. By microscopic evaluation, these plants showed high levels of GFP expression in developing embryos, little or no GFP expression in endosperm, and low levels of GFP expression in seedlings.

Rice plants homozygous for the LEC2 transgene were crossed as females with CR19-60-1 and CR19-60-2 plants. Samples of the developing $F_1$ embryos were collected at 5 days, 8 days, and 12 days after pollination.

Nine embryos collected at 5 days after pollination were observed under a dissecting microscope and a fluorescent microscope. The presence or absence of the Hap1-VP16 chimeric gene was determined based on the presence or absence of GFP reporter gene activity as visualized with a UV-equipped microscope. Four embryos were found to have received the Hap1-VP16 gene. The development of these embryos was delayed and was equivalent to the development of a corresponding control embryo at 3 days after pollination. In addition, the scutellum and first leaf were found to be fused. The other 5 embryos did not have the Hap1-VP16 chimeric gene and showed normal development.

At 8 days after pollination, developing embryos were placed on phytohormone-free MS germination media and germination was observed for up to 24 days. Of 10 embryos evaluated, 1 embryo contained both Hap1-VP16 and LEC2. This embryo was found to have lost the ability to germinate. The other 9 control embryos did not contain the Hap1-VP16 chimeric gene, and formed normal seedlings.

Seventeen embryos collected at 12 days after pollination were dissected by cutting longitudinally through the embryonic axis. Dissected embryos were then observed under a dissecting microscope, and it was found that the 7 Hap1-VP16 expressing embryos formed multiple shoots but no root primordium initiation. In addition, the leaves were not well developed. The other 10 embryos did not contain Hap1-VP16 and showed normal shoot, root and leaf differentiation.

Mature $F_1$ seed was collected 27 days after pollination and allowed to dry. Thirteen seeds contained both pLEC2 and the activation construct CR19. Twenty five seeds contained the pLEC2 construct only. $F_1$ seeds, together with control seeds, were germinated on agar plates containing hormone-free 0.5× Murashige and Skoog (MS) salts, 1.5 percent sucrose and 0.25 percent Gelrite. Germination efficiency was scored 19 days later. Seeds containing Hap1-VP16 and expressing LEC2 were completely infertile and had 0% germination, whereas control seeds had 100% germination. These data indicate that embryo-targeted LEC2 expression results in infertile seed.

A similar experiment was conducted using Hap1-VP16 lines selected for targeting to the endosperm. Two different endosperm-specific promoters were used to drive Hap1-VP16. Transgenic plants obtained from each transformation expressed GFP targeted to endosperm only. Plants homozygous for Hap1-VP16 and GFP were obtained after selfing for 2 generations and used to pollinate the pLEC2 homozygous plants. Mature $F_1$ seed was collected and allowed to dry. F1 Seeds containing Hap1-VP16 and expressing LEC2 were fertile and had a normal germination rate on the phytohormone-free MS medium. These data indicate that endosperm-targeted LEC2 expression results in fertile seed.

Example 3

Transgenic Soybean Plants

A soybean plant homozygous for a transgene comprising the LEC2 coding sequence operably linked to 5 copies of a $UAS_{Hap1}$ and a 35S minimal promoter is crossed as a female, using pollen from a soybean plant homozygous for a transgene comprising a HAP1-VP16 polypeptide operably linked to an embryo-targeted regulatory sequence. The soybean plant used as a female also is homozygous for a transgene comprising the coding sequence for a tumor necrosis factor receptor polypeptide, operably linked to 5 copies of a $UAS_{Hap1}$ and a 35S minimal promoter. See, e.g., U.S. Pat. No. 6,541,610.

At maturity, $F_1$ seeds are collected and stored under standard conditions. Any tumor necrosis factor receptor expressed in the $F_1$ seeds is extracted. At 7, 14, and 21 days after pollination, some of the embryos and seeds developing on $F_1$ plants are examined under a microscope. Mature seed also are scored for viability and germination and tested for the presence of tumor necrosis factor receptor coding sequence by PCR. The procedure is repeated using corn plants instead of soybean plants.

It is to be understood that while the invention has been described in conjunction with the detailed description thereof, the foregoing description is intended to illustrate and not limit the scope of the invention.

SEQUENCE LISTING (263 sequences)

SEQ ID NO: 1 - DNA, 524 bp, Brassica napus
  misc_feature (1)...(524): Ceres Seq. ID no. 13507036
attatcatcatcacatccctctcttcttcactacaacacacaaaaatggagaaaccatcctcaatgaaacaatggaagaaaggtccagctcgtggcaaaggcggtccacaaaacgctctttgccgttaccgtggagtgaggcaaagaacatggggcaaatgggtggctgagatcagagagcccaagaagagagcaagactctggctcggctctttcgctacagctgaagaagcagccatggcttatgacgaagccgcgctgaaactatatggtcctgaagcttatctcaacttacctcatcttcagcagaggaaacaacaaggacctcctctgaacaacactcagaggtttaaatgggttccttcaaagaagtttatctccatgtttccttctcgcggtttgctgaatgtgaatgctcagcctagtgttcaagttatccagcagagacttgatgagctcaagagaaacgggcttctatctcagtcctattcttctagctcttcctccacggagtcgaaaagcct

SEQ ID NO: 2 - protein, 174 aa, Brassica napus
  VARIANT (1)...(174): Ceres Seq. ID no. 13507037
IIIITSLSSSLQHTKMEKPSSMKQWKKGPARGKGGPQNALCRYRGVRQRTWGKWVAEIREPKKRARLWLGSFATAEEAAMAYDEAALKLYGPEAYLNLPHLQQRKQQGPPLNNTQRFKWVPSKKFISMFPSRGLLNVNAQPSVQVIQQRLDELKRNGLLSQSYSSSSSSTESKS

SEQ ID NO: 3 - protein, 159 aa, Brassica napus
  VARIANT (1)...(159): Ceres Seq. ID no. 13507038
MEKPSSMKQWKKGPARGKGGPQNALCRYRGVRQRTWGKWVAEIREPKKRARLWLGSFATAEEAAMAYDEAALKLYGPEAYLNLPHLQQRKQQGPPLNNTQRFKWVPSKKFISMFPSRGLLNVNAQPSVQVIQQRLDELKRNGLLSQSYSSSSSSTESKS

SEQ ID NO: 4 - protein, 153 aa, Brassica napus
  VARIANT (1)...(153): Ceres Seq. ID no. 13507039
MKQWKKGPARGKGGPQNALCRYRGVRQRTWGKWVAEIREPKKRARLWLGSFATAEEAAMAYDEAALKLYGPEAYLNLPHLQQRKQQGPPLNNTQRFKWVPSKKFISMFPSRGLLNVNAQPSVQVIQQRLDELKRNGLLSQSYSSSSSSTESKS

SEQ ID NO: 5 - DNA, 404 bp, Brassica napus
  misc_feature (1)...(404): Ceres Seq. ID no. 4450880
aagacaatcttctctttctccactctcattctctttctcactctgacgcatcaactacttatttttcctgcattgctttctctctatctctatctctcacacacgcatacacacaaagacatttaacatatatcaagaaagaagatgtcgagcagaagatcatcatgttcaagacagtccgggagctcaagaatctctgacgatcaaatttccgatctagttaccaagcttcaacacctcatccctgaactccgccgccgccgttctgacmaggtgtcagcatctaaggtactacaagagacttgcaactacatcaggaacttacacagagaggttgatgatctcagtgaccgattgtccgaatttttggcttccacggacgacaacagcgccgaarcagccat

SEQ ID NO: 6 - protein, 86 aa, Brassica napus
  VARIANT (1)...(86): Ceres Seq. ID no. 4450881
  VARIANT (1)...(86): Xaa = any amino acid
MSSRRSSCSRQSGSSRISDDQISDLVTKLQHLIPELRRRRSDXVSASKVLQETCNYIRNLHREVDDLSDRLSEFLASTDDNSAEXA

SEQ ID NO: 7 - protein, 65 aa, Brassica napus
  VARIANT (1)...(65): Ceres Seq. ID no. 4450882
DNLLFLHSHSLSHSDASTTYFSCIAFSLSLSLTHAYTQRHLTYIKKEDVEQKIIMFKTVRELKNL

SEQ ID NO: 8 - DNA, 520 bp, Brassica napus
  misc_feature (1)...(520): Ceres Seq. ID no. 13507815
  misc_feature (1)...(520): n = A,T,C or G
aaaaccctaacatccgtccccactccccaatcaacctgccgccgcccgccagcaccaaacttccatccgccccgagctctgcctccgccgccgccgcgccatgaggcctctcgacgagaaggagacgactcaggtattcgagaagctgttcaagttcacggggcccaacctgaagcacctcctggagcgccccgcagtggagggccccgacgcggagcccggccgctactgcctccggcttcaccgcaatcgcgtctactacgcctccgaggcgctcgtgcgccgcgccaccgccgtgtcccgaccgcgcctcgccggcgtggggacgcccatcggcaagttcacccaccacggcgcgttccaccttacggtccacgcgctcgacctcctcgctgtacacgcgcgccgscgcgtctggctcaaacccgacaccgagcgttcctttctctttggcaattccgtgcccaagtcttctctcgctcgcatyaccgagaacaccaangccggggacggggtggtc

SEQ ID NO: 9 - protein, 173 aa, Brassica napus
  VARIANT (1)...(173): Ceres Seq. ID no. 13507816
  VARIANT (1)...(173): Xaa = any amino acid
KTLTSVPTPQSTCRRPPAPNFHPPRALPPPPPRHEASRREGDDSGIREAVQVHGAQPEAPPGAPRSGGPRRGARPLLPPASPQSRLLRLRGARAPRHRRVPTAPRRRGDAHRQVHPPRRVPPYGPRARPPRCTRAPXRLAQTRHRAFLSLWQFRAQVFSRSHXREHQXRGRGG

SEQ ID NO: 10 - protein, 140 aa, Brassica napus
  VARIANT (1)...(140): Ceres Seq. ID no. 13507817
  VARIANT (1)...(140): Xaa = any amino acid
MRPLDEKETTQVFEKLFKFTGPNLKHLLERPAVEGPDAEPGRYCLRLHRNRVYYASEALVRRATAVSRPRLAGVGTPIGKFTHHGAFHLTVHALDLLAVHARXRVWLKPDTERSFLFGNSVPKSSLARXTENTXAGDGVV

SEQ ID NO: 11 - DNA, 451 bp, Brassica napus
  misc_feature (1)...(451): Ceres Seq. ID no. 4435719
aaatcagtgacaattcctaccttgcgccggtggtttgcggctcttcgaaaatgggtgcgtacaagtatgtgtctgagctatggaggaagaaacaatccgatgtgatgaggtttgtgcagagggtgaggtgctgggagtacagacagcagccttccattgtccgtctcgtcaggcctactcgtcccgacaaggctcgccgtttgggttacaaggccaagcagggctttgtggtgtaccgtgtacgtgtgagacgtggtggaagaaagaggccagtcccaaagggtattgtgtatggtaaacccacaaaccagggagttactcaactcaagttccagaggagcaagcgttctgttgctgaggagcgtgctggaaggaaactgggcggtctaagagtcgtcaactcctactggctcaacgaggattcgacgtacaagtactacgagatcatctt

SEQ ID NO: 12 - protein, 149 aa, Brassica napus
  VARIANT (1)...(149): Ceres Seq. ID no. 4435720
ISDNSYLAPVVCGSSKMGAYKYVSELWRKKQSDVMRFVQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEII

SEQ ID NO: 13 - protein, 133 aa, Brassica napus
  VARIANT (1)...(133): Ceres Seq. ID no. 4435721
MGAYKYVSELWRKKQSDVMRFVQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEII

SEQ ID NO: 14 - protein, 115 aa, Brassica napus
  VARIANT (1)...(115): Ceres Seq. ID no. 4435722
MRFVQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEII

SEQ ID NO: 15 - DNA, 497 bp, Brassica napus
  misc_feature (1)...(497): Ceres Seq. ID no. 12474809
  misc_feature (1)...(497): n = A,T,C or G
gtcggccacattatgtttggtactaaattcctctaaaaccctaaaaacagagagcatccgtcttcccaaaaaaaaagatgcggccgttagacgagaacgagacgacagtggtcttcgagaagatcttcaaattcgtcggaaacaacctcaagaacatcgtcgagaacccatcccacgaaggacccggacccaaacccgaagccgggcgctactgcttccgcctccagaagagcagagtctactacgtaagcgagtctctcgtgaagcgagccaccaacatctcccgcaaaaacctagtctccctcggaacctgcatcgggaagtacacccacgcggggagcttccaccttacgatcatgtcgctcaacctcttggccgcgaacgcgaagcacaaggtttggcttaaacccacttcggagatgtcgtttctttacgggaaccatgtcttgaaaggagggctagggaggattaccgatagtattgngcctggagatggg

SEQ ID NO: 16 - protein, 140 aa, Brassica napus
  VARIANT (1)...(140): Ceres Seq. ID no. 12474810
  VARIANT (1)...(140): Xaa = any amino acid
MRPLDENETTVVFEKIFKFVGNNLKNIVENPSHEGPGPKPEAGRYCFRLQKSRVYYVSESLVKRATNISRKNLVSLGTCIGKYTHAGSFHLTIMSLNLLAANAKHKVWLKPTSEMSFLYGNHVLKGGLGRITDSIXPGDG

SEQ ID NO: 17 - protein, 134 aa, Brassica napus
  VARIANT (1)...(134): Ceres Seq. ID no. 12474811
SATLCLVLNSSKTLKTESIRLPKKKDAAVRRERDDSGLREDLQIRRKQPQEHRREPIPRRTRTQTRSRALLLPPPEEQSLLRKRVSREASHQHLPQKPSLPRNLHREVHPRGELPPYDHVAQPLGREREAQGLA

SEQ ID NO: 18 - DNA, 814 bp, Brassica napus
  misc_feature (1)...(814): Ceres Seq. ID no. 13504237
  misc_feature (1)...(814): n = A,T,C or G
gaagcttttttttatctctctctccgccgtcactctcacctgcggcgaggcttaacgatctcagccatggccgccgccgtagaaatcgacgcagagatccagcagcagcttaccaacgaggtcaagctcttcaaccgctggacctacgatgacgtctcggttgcagatatcagtcttgttgactacattggagttcaagcagccaaacacgccacctttgtcccccacactgcaggaagatactctgtgaagagattcaggaaggctcagtgcccaattgttgagaggctcacaaactctctcatgatgcacggaagaaacaatggaaagaagttgatggcggtgaggatcatcaagcacgccatggagatcatccacctcttgactgacgccaacccgattcagatcatcatcgatgccattgtcaacagtggtccacgtgaagatgccaccagaattggatctgctggtgtcgttaggagacaagctgttgatatctctcctttgagacgtgttaaccaggcgatcttcttgctcacaaccggtgctcgtgaggctgctttcagaaacattaagactattgctgagtgccttgctgatgagttaatcaacgcagccaagggctcgtccaacagctatgccatcaaaaagaaggatgagattgagagagttgccaaggctaatcgttaagggaaagtcttcttttaccctgatggttgttacaatcttatcaatgaaatttatgttttgtttcgactaagattgggaatatgtaacagatgttttgctcttttcgtcttangaaagnttattt

SEQ ID NO: 19 - protein, 229 aa, Brassica napus
  VARIANT (1)...(229): Ceres Seq. ID no. 13504238
EAFFYLSLRRHSHLRRGLTISAMAAAVEIDAEIQQQLTNEVKLFNRWTYDDVSVADISLVDYIGVQAAKHATFVPHTAGRYSVKRFRKAQCPIVERLTNSLMMHGRNNGKKLMAVRIIKHAMEIIHLLTDANPIQIIIDAIVNSGPREDATRIGSAGVVRRQAVDISPLRRVNQAIFLLTTGAREAAFRNIKTIAECLADELINAAKGSSNSYAIKKKDEIERVAKANR

SEQ ID NO: 20 - protein, 207 aa, Brassica napus
  VARIANT (1)...(207): Ceres Seq. ID no. 13504239
MAAAVEIDAEIQQQLTNEVKLFNRWTYDDVSVADISLVDYIGVQAAKHATFVPHTAGRYSVKRFRKAQCPIVERLTNSLMMHGRNNGKKLMAVRIIKHAMEIIHLLTDANPIQIIIDAIVNSGPREDATRIGSAGVVRRQAVDISPLRRVNQAIFLLTTGAREAAFRNIKTIAECLADELINAAKGSSNSYAIKKKDEIERVAKANR

SEQ ID NO: 21 - protein, 128 aa, Brassica napus
  VARIANT (1)...(128): Ceres Seq. ID no. 13504240
MMHGRNNGKKLMAVRIIKHAMEIIHLLTDANPIQIIIDAIVNSGPREDATRIGSAGVVRRQAVDISPLRRVNQAIFLLTTGAREAAFRNIKTIAECLADELINAAKGSSNSYAIKKKDEIERVAKANR

SEQ ID NO: 22 - DNA, 724 bp, Brassica napus
  misc_feature (1)...(724): Ceres Seq. ID no. 12472572
ataaatttcgatcgatgtctacgttcttaacacaattcacaatcttctttagaatccaaaatcattgttcgaagaagaaaaaaccgaagatggcaacaacatccacgggagatatcgagaaaacgaagtcagtagaagtgaagaagaaacttaacgtgttgatcgtcgatgatgatcctgtaattcgtaaacttcacgagattatcatcaaatcaatcggtggaatttcacagacagctaagaacggtgaggaggcagtgaacatccaccgcgacggcaatgcatctttcgaccttatcctaatggataaagaaatgcccgagagggatggactttcggcaactaagaagctaagagaaatgaaagtgacgtctatgattattggggtgacgacactggctgacaatgaagaggaacgtaaggctttcatggaagctggacttaaccattgcttggcaaagcccttaagcaaagccaagatcctccctctcatcaacaatctcatggatgcttgatggatggatgaattgtcgccactacatatctacattatataaatatgaaaaacacataataacgtcagcttatacacctgtgtgtgtatgcatatatctatctgcatgtgtgtgttttagggttgttatgtttgatttttatcgtgcgtggcgtgatatacaatcatgtaagtcattacttttggcttataaaataatgaataagattt

SEQ ID NO: 23 - protein, 170 aa, Brassica napus
  VARIANT (1)...(170): Ceres Seq. ID no. 12472573
KFRSMSTFLTQFTIFFRIQNHCSKKKKPKMATTSTGDIEKTKSVEVKKKLNVLIVDDDPVIRKLHEIIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 24 - protein, 166 aa, Brassica napus
  VARIANT (1)...(166): Ceres Seq. ID no. 12472574
MSTFLTQFTIFFRIQNHCSKKKKPKMATTSTGDIEKTKSVEVKKKLNVLIVDDDPVIRKLHEIIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 25 - protein, 141 aa, Brassica napus
  VARIANT (1)...(141): Ceres Seq. ID no. 12472575
MATTSTGDIEKTKSVEVKKKLNVLIVDDDPVIRKLHEIIIKSIGGISQTAKNGEEAVNIHRDGNASFDLILMDKEMPERDGLSATKKLREMKVTSMIIGVTTLADNEEERKAFMEAGLNHCLAKPLSKAKILPLINNLMDA

SEQ ID NO: 26 - DNA, 568 bp, Brassica napus
  misc_feature (1)...(568): Ceres Seq. ID no. 13508521
gatttgatcattttcaggttcgctttgctcttctccctcgctgcagattctgttcgttacttctctcaattccttaattgtaatctgttcggatgagaattagtcgttgagcgttgtttctgtgtggtgttttctctctgaatccattgtgctttcgcattagatctctcattgccgtaatcaattttcttagagtgttaagttgttagttacaatcaattttttacattagcttgtttgggggtgttttggtctttgttaaaagatcacagcaaataaaaatgggagctacgaagctttccgggatgcaaaagcaagtcctgagtctctacagaggattcctaagagcagctcgttcaaagccaacgacggaagacaggaagagaatagagacggtcgtgtcgacagagtttcgcaagaactcaaaggaggttgaccgtaagaactttcagtacattgagtatctgcttcggctagctcataaacaacttgaccaactcaaaagtcccgatatggkttccatctcctctgtgaagatcaactagtctttatatctctcaaggkgatc

SEQ ID NO: 27 - protein, 87 aa, Brassica napus
  VARIANT (1)...(87): Ceres Seq. ID no. 13508522
  VARIANT (1)...(87): Xaa = any amino acid
MGATKLSGMQKQVLSLYRGFLRAARSKPTTEDRKRIETVVSTEFRKNSKEVDRKNFQYIEYLLRLAHKQLDQLKSPDMXSISSVKIN

SEQ ID NO: 28 - protein, 79 aa, Brassica napus
  VARIANT (1)...(79): Ceres Seq. ID no. 13508523
  VARIANT (1)...(79): Xaa = any amino acid
MQKQVLSLYRGFLRAARSKPTTEDRKRIETVVSTEFRKNSKEVDRKNFQYIEYLLRLAHKQLDQLKSPDMXSISSVKIN

SEQ ID NO: 29 - DNA, 432 bp, Brassica napus
  misc_feature (1)...(432): Ceres Seq. ID no. 4625303
attgcttctctgaatttctatattcgttaatcagaagccgttttgatcattttcaggtgttttgactttgttaaagataacaacagcaaataaaaatgggagctacgaaactttcggggatgcaaaagcaagtcctgagtctctacagaggattcctaagagcagctcgttcaacggaagacaggaagagaatacagacgatcgtgtcgacagagtttcgcaagaactcaaaggaggttgaccgtaagaactttcagtacatcgagtatctgcttcggctagctcataaacaacttgaccaactcaaaagtcccgatatggtttccatctcctctgtgaagatcaactagtctttatatctctcaaggtgatcatatttgttatgtagaatcatcatagagaatcaaagagaggcaaactgattcctttaat

SEQ ID NO: 30 - protein, 84 aa, Brassica napus
  VARIANT (1)...(84): Ceres Seq. ID no. 4625304
MGATKLSGMQKQVLSLYRGFLRAARSTEDRKRIQTIVSTEFRKNSKEVDRKNFQYIEYLLRLAHKQLDQLKSPDMVSISSVKIN

SEQ ID NO: 31 - protein, 76 aa, Brassica napus
  VARIANT (1)...(76): Ceres Seq. ID no. 4625305
MQKQVLSLYRGFLRAARSTEDRKRIQTIVSTEFRKNSKEVDRKNFQYIEYLLRLAHKQLDQLKSPDMVSISSVKIN

SEQ ID NO: 32 - DNA, 634 bp, Brassica napus
  misc_feature (1)...(634): Ceres Seq. ID no. 13503679
attcacaatcttctttagaatccaaattattgttctaagacagaatcgaagatggcaacaaaatccatgggagatatcgagaaaataaagaagaaactaaacgtgttgatcgtcgatgatgatccactaaaccttataattcatgagaagatcatcaaagcgattgggggtatttcacagacagcgaataacggtgaggaggcagtaatcatccaccgtgacggcggctcatcttttgaccttatcctaatggataaagaaatgcccgagagggatggtgtttcgacaactaagaagctaagagaaatggaagtgaagtcaatgattgttggggtgacttcactggctgacaatgaagaggagcgcagggctttcatggaagctggacttaaccattgcttggcaaaaccgttaaccaaggacaagatcatccctctcattaaccaactcatggatgcttgatggatatatattttatattatggaaacacacataataacgtctaagtgtgtatgtatgcatagatacttgcatgtgtgtgttttagaatttagggttctttatcgtccgtgatatataatcatgtaagttgttgctttaagcttataaaatatttaaataagggtttcctct

SEQ ID NO: 33 - protein, 136 aa, Brassica napus
  VARIANT (1)...(136): Ceres Seq. ID no. 13503680
MATKSMGDIEKIKKKLNVLIVDDDPLNLIIHEKIIKAIGGISQTANNGEEAVIIHRDGGSSFDLILMDKEMPERDGVSTTKKLREMEVKSMIVGVTSLADNEEERRAFMEAGLNHCLAKPLTKDKIIPLINQLMDA

SEQ ID NO: 34 - protein, 131 aa, Brassica napus
  VARIANT (1)...(131): Ceres Seq. ID no. 13503681
MGDIEKIKKKLNVLIVDDDPLNLIIHEKIIKAIGGISQTANNGEEAVIIHRDGGSSFDLILMDKEMPERDGVSTTKKLREMEVKSMIVGVTSLADNEEERRAFMEAGLNHCLAKPLTKDKIIPLINQLMDA

SEQ ID NO: 35 - protein, 70 aa, Brassica napus
  VARIANT (1)...(70): Ceres Seq. ID no. 13503682
MDKEMPERDGVSTTKKLREMEVKSMIVGVTSLADNEEERRAFMEAGLNHCLAKPLTKDKIIPLINQLMDA

SEQ ID NO: 36 - DNA, 475 bp, Brassica napus
  misc_feature (1)...(475): Ceres Seq. ID no. 4794495
aaaacttycttctttccttttttcttttcctgttgtcttgtattccgaaagctgaattgagttgggtgaagcaattctcaggatgggaagaggaaagatagaaatcaagaggatagagaattcaacaaatcgacaagtgacgttctgcaaaagaagaaatggactcctgaagaaggcttacgagctttcagttctctgtgatgccgaggttgccctcatcgtcttctcaactcgtggccgtctctatgagtacgccaataacaacataagatcaaccattgagaggtacaagaaggcttctgataacaccaacactcactctgtacaagagattaatgcagcgtactatcaacaagaatctgcaaagctgaggcaacagatccaaacgattcaaaattccaacaggcatctgatgggagactctttgagtgccttaagtgtcaaggagctaaaacaggttgagaatcgccttgag

SEQ ID NO: 37 - protein, 131 aa, Brassica napus
  VARIANT (1)...(131): Ceres Seq. ID no. 4794496
MGRGKIEIKRIENSTNRQVTFCKRRNGLLKKAYELSVLCDAEVALIVFSTRGRLYEYANNNIRSTIERYKKASDNTNTHSVQEINAAYYQQESAKLRQQIQTIQNSNRHLMGDSLSALSVKELKQVENRLE

SEQ ID NO: 38 - DNA, 452 bp, Brassica napus
  misc_feature (1)...(452): Ceres Seq. ID no. 6426831
ctaagcagcaatggatcttctcttgttggaaaaatctctgatcgccgtctttgcggcggtggttctcgccaccgtgatctccaagctccgcggsgggaaactaaacctacctcctggtcctattcccattcccatcttcggaaactggctacaagtgggagatgatctcaaccaccgtaacctcgtcgactacgccaagaagttcggagacctcttcctcctccgtatgggccaacgaaacctagtcgtcgtctcttcaccaaacctaaccaaagaagtgctccacacgcaaggcgtagagttcggatctcggacaagaaacgtcgtcttcgacatcttcacaggcaaaggacaggacatggtgttcacagtgtacggcgaacactggcgtaagatgcgtcggatcatgacggttccgtttttcaccaacaaggttgtgcaacggaacaggg

SEQ ID NO: 39 - protein, 147 aa, Brassica napus
  VARIANT (1)...(147): Ceres Seq. ID no. 6426832
  VARIANT (1)...(147): Xaa = any amino acid
MDLLLLEKSLIAVFAAVVLATVISKLRXGKLNLPPGPIPIPIFGNWLQVGDDLNHRNLVDYAKKFGDLFLLRMGQRNLVVVSSPNLTKEVLHTQGVEFGSRTRNVVFDIFTGKGQDMVFTVYGEHWRKMRRIMTVPFFTNKVVQRNR

SEQ ID NO: 40 - protein, 75 aa, Brassica napus
  VARIANT (1)...(75): Ceres Seq. ID no. 6426833
MGQRNLVVVSSPNLTKEVLHTQGVEFGSRTRNVVFDIFTGKGQDMVFTVYGEHWRKMRRIMTVPFFTNKVVQRNR

SEQ ID NO: 41 - DNA, 426 bp, Brassica napus
  misc_feature (1)...(426): Ceres Seq. ID no. 6425768
gagaggattcgagtttttctatagtctagacaacactcgagctccgtttcgtttgacaccgagattgcactcagcgccgtcccgtgtcacaaaccctccgacgagctctccggcagccatgtacggcggagatgaagtgtcagctatagtggttgacttgggttcgcacacttgcaaggctggctacgccggcgaggatgctcccaaggccgtcttcccttccgttgttggggcagtggatggagtagaggcaatggaagtggatgttgattctgcaaagactaattcgaattcagaggataagtctgaaaaggacaagggtaaacgcaagctctgtgtgggatctcaagccttgaattaccgcagggatcatatggagatcttgtcaccgatcaaagatggcatagtttctgattgggatttggt

SEQ ID NO: 42 - protein, 141 aa, Brassica napus
  VARIANT (1)...(141): Ceres Seq. ID no. 6425769
RGFEFFYSLDNTRAPFRLTPRLHSAPSRVTNPPTSSPAAMYGGDEVSAIVVDLGSHTCKAGYAGEDAPKAVFPSVVGAVDGVEAMEVDVDSAKTNSNSEDKSEKDKGKRKLCVGSQALNYRRDHMEILSPIKDGIVSDWDL

SEQ ID NO: 43 - protein, 102 aa, Brassica napus
  VARIANT (1)...(102): Ceres Seq. ID no. 6425770
MYGGDEVSAIVVDLGSHTCKAGYAGEDAPKAVFPSVVGAVDGVEAMEVDVDSAKTNSNSEDKSEKDKGKRKLCVGSQALNYRRDHMEILSPIKDGIVSDWDL

SEQ ID NO: 44 - DNA, 481 bp, Brassica napus
  misc_feature (1)...(481): Ceres Seq. ID no. 6425497
caaacacttatcttcaaatcctgatcaaatctttgtcttgtaaacacagaaagttcttaagcaatggaagctacttcacagccttgtttctctcataattaccgtagatcatctgaaaactacaactcatcgctccattcgacacgaaagcaaccagcaaagccatggaaaagacccgtaacagcttcgcttcaacgaatgcatcccagagtttaccgagtcgagcctgtgaacttcaaagagttggttcagagtctaaccggcgcaccacaagatcatgagagagatcaggtgcatcaagttgaaactaagccactactcaagatgcaacacggtctagttgaggttaggcagccacttaagattttccatgaaacaacaactcaagagaacccagtggcgtttgatctgtctccttcatcatctcgtttttgggaagctttccctcttctcagtcctgcgaatctatcaagatggtagg

SEQ ID NO: 45 - protein, 138 aa, Brassica napus
  VARIANT (1)...(138): Ceres Seq. ID no. 6425498
MEATSQPCFSHNYRRSSENYNSSLHSTRKQPAKPWKRPVTASLQRMHPRVYRVEPVNFKELVQSLTGAPQDHERDQVHQVETKPLLKMQHGLVEVRQPLKIFHETTTQENPVAFDLSPSSSRFWEAFPLLSPANLSRW

SEQ ID NO: 46 - protein, 93 aa, Brassica napus
  VARIANT (1)...(93): Ceres Seq. ID no. 6425499
MHPRVYRVEPVNFKELVQSLTGAPQDHERDQVHQVETKPLLKMQHGLVEVRQPLKIFHETTTQENPVAFDLSPSSSRFWEAFPLLSPANLSRW

SEQ ID NO: 47 - DNA, 527 bp, Brassica napus
  misc_feature (1)...(527): Ceres Seq. ID no. 6416837
  misc_feature (1)...(527): n = A,T,C or G
atatcagtcacaccaccaacaaagtagctccctttttcttcaatcactaactcctccgtctcaagaagcgaagaacaaagttacatcttcttgttctccttcctctggtgctcctgcttattctttcatggagatcaatcaccaaaacgaactcctcgcaggaggactcaatccctgttcttcagcctctgtcaaggccaaaatcatgggtcatcctcactaccaccgcctcttactcgcctatgtcaattgccagaaggtgggagctccaccggaagtgcaggcgaggctggaagaaacatgctcgtctgcggcggcagccgcagcgtcgatgggacccacaggttctttaggtgaagatccagggcttgatcagttcatggaagcgtactgtgaaatgctcgttaagtacgagcaagaactctctaaaccttttaaagaagctatggtcttccttcaacacgtcgagtgtcaattcaaatccctctctctctcctcgccttnctccttctctggttatggagagg

SEQ ID NO: 48 - protein, 175 aa, Brassica napus
  VARIANT (1)...(175): Ceres Seq. ID no. 6416838
  VARIANT (1)...(175): Xaa = any amino acid
YQSHHQQSSSLFLQSLTPPSQEAKNKVTSSCSPSSGAPAYSFMEINHQNELLAGGLNPCSSASVKAKIMGHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPXSFSGYGE

SEQ ID NO: 49 - protein, 133 aa, Brassica napus
  VARIANT (1)...(133): Ceres Seq. ID no. 6416839
  VARIANT (1)...(133): Xaa = any amino acid
MEINHQNELLAGGLNPCSSASVKAKIMGHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPXSFSGYGE

SEQ ID NO: 50 - protein, 107 aa, Brassica napus
  VARIANT (1)...(107): Ceres Seq. ID no. 6416840
  VARIANT (1)...(107): Xaa = any amino acid
MGHPHYHRLLLAYVNCQKVGAPPEVQARLEETCSSAAAAAASMGPTGSLGEDPGLDQFMEAYCEMLVKYEQELSKPFKEAMVFLQHVECQFKSLSLSSPXSFSGYGE

SEQ ID NO: 51 - DNA, 557 bp, Arabidopsis thaliana
  misc_feature (1)...(557): Ceres Seq. ID no. 12330042
atactatcaacttttctctatctatctctctctcttctttttccggcataacttctgtgttaccctaaactccataacctgtttcatcgataaagtgcctttgcttctatctctgtcactcttactacttgttgaacaatattctacaaaaaaatgtcgggaagaagatcacgttcgaggcaatcatcaggaacttcaaggatctcagaagatcaaatcaatgatctgattatcaagttgcaacagcttcttcctgagctcagggacagtcgtcgttccgacaaggtttcagcagcgagggtgttacaagatacgtgcaactacatacggaatctgcatagagaggttgatgatctaagtgagaggctatctgagttactagcaaactcagacactgcacaagctgctttaatcagaagcttacttacccaataattcctatctatctttttcttcttcttcttttttttgtttactataataataataatagtttgcgggtttttttttctatagatgttgatgaccttataaacgtttaatgatacgagttcgtc

SEQ ID NO: 52 - protein, 93 aa, Arabidopsis thaliana
  VARIANT (1)...(93): Ceres Seq. ID no. 12330043
MSGRRSRSRQSSGTSRISEDQINDLIIKLQQLLPELRDSRRSDKVSAARVLQDTCNYIRNLHREVDDLSERLSELLANSDTAQAALIRSLLTQ

SEQ ID NO: 53 - protein, 75 aa, Arabidopsis thaliana
  VARIANT (1)...(75): Ceres Seq. ID no. 12330044
YYQLFSIYLSLFFFRHNFCVTLNSITCFIDKVPLLLSLSLLLLVEQYSTKKCREEDHVRGNHQELQGSQKIKSMI

SEQ ID NO: 54 - DNA, 911 bp, Arabidopsis thaliana
  misc_feature (1)...(911): Ceres Seq. ID no. 12420894
ctcttaaagcttctcgttttctctgccgtctctctcattcgcgcgacgcaaacgatcttcagccatggccaccgccgcagatgttgacgctgagattcagcaggcgctcactaacgaagtcaagctcttcaaccgctggacctatgacgacgttacggtcacagacatcagtcttgttgactacattggagttcaggcagctaaacatgctacctttgttccccacaccgctggaagatactctgtgaagagattcaggaaggctcagtgccccattgttgagaggctcaccaactctctcatgatgcacgggaggaacaacggtaagaaattgatggctgtcaggatcgtcaagcacgccatggagattatccacctcttgtctgacttgaacccaattcaggtcatcattgacgccattgtcaacagtggtccacgtgaagatgctaccagaattggatctgctggtgttgttaggagacaagctgttgatatctctcctctaagacgtgttaaccaggctatcttcttgattaccactggtgctcgtgaagctgctttcagaaacatcaagactatagctgagtgccttgctgatgaattgatcaacgcagccaagggctcttccaacagctatgccatcaagaagaaggatgagattgaaagagttgccaaggctaatcgttaaggattttccctttgccctgtgcgttacaatctcgtatcaatgagtttaatgttttatcttcatttagattgaaatatgtatctcagatgtttgctcttttgttttatgaagtttatttcgtctgaactactttgaatagataaatttttgatgctttaagctgtttcgcatcagtttattgtcaatttttgaacttatctaggccacctgaagctagaaattt

SEQ ID NO: 55 - protein, 207 aa, Arabidopsis thaliana [sequence omitted]

SEQ ID NO: 56 - protein, 128 aa, Arabidopsis thaliana
  VARIANT (1)...(128): Ceres Seq. ID no. 12420896
MMHGRNNGKKLMAVRIVKHAMEIIHLLSDLNPIQVIIDAIVNSGPREDATRIGSAGVVRRQAVDISPLRRVNQAIFLITTGAREAAFRNIKTIAECLADELINAAKGSSNSYAIKKKDEIERVAKANR

SEQ ID NO: 57 - protein, 127 aa, Arabidopsis thaliana
  VARIANT (1)...(127): Ceres Seq. ID no. 12420897
MHGRNNGKKLMAVRIVKHAMEIIHLLSDLNPIQVIIDAIVNSGPREDATRIGSAGVVRRQAVDISPLRRVNQAIFLITTGAREAAFRNIKTIAECLADELINAAKGSSNSYAIKKKDEIERVAKANR

SEQ ID NO: 58 - DNA, 1198 bp, Arabidopsis thaliana
  misc_feature (1)...(1198): Ceres Seq. ID no. 13491860
atatcagtcacaccaccaacaaagtagttccctttttcttcaatcactagctcctccccaaggaactaagaacaaagttgcttcttcttcttctccttcctcttgtgctcctgcctattctctaatggagatccatcataacgaaatcgttgcaggaggaatcaacccttgctcctcttcctcttcttcagcctctgtcaaggccaagatcatggctcatcctcactaccaccgcctcttggccgcttatgtcaattgtcagaaggttggagcaccaccggaggttgtggcgaggctagaggaggcatgctcgtctgccgcagccgctgccgcatctatgggaccaacaggatgtctaggtgaagatccagggcttgatcaattcatggaagcttactgtgaaatgctcgttaagtatgagcaagagctctccaaacctttcaaggaagctatggtcttccttcaacgtgtcgagtgtcaattcaaatccctctctctatcctcaccttcctctttctccggttatggagagacagcaattgataggaacaataatgggtcatccgaggaagaagtcgatatgaacaatgaatttgtagatccacaagctgaggatagagagcttaaaggacagctcttgcgcaagtacagtggttacttagggagcctcaagcaagagttcatgaagaagaggaagaaaggaaagctccctaaagaagctcgtcaacaactgcttgattggtggagccgtcactacaaatggccttacccttcggagcaacaaaagctcgcccttgcggaatcaacggggctggaccagaaacagataaacaattggttcataaaccagaggaaacggcattggaagccgtcggaggacatgcagtttgtagtaatggacgcaacacatcctcaccattacttcatggataatgtcttgggcaatcctttcccaatggatcacatctcctccaccatgctttgatcgatcctttaaaacgtttatttcattatatttataatcgttaaacagcttataatatgtataatctatggttctcggtatacttggaacatatgaaacatgttccgattgatgaacaagcgtttgatgttgtggtgtgtatccttttgtgttgttctattgttatgcgaaattcctattcctattataatgatagtaaagcttttttgatct

SEQ ID NO: 59 - protein, 327 aa, Arabidopsis thaliana
  VARIANT (1)...(327): Ceres Seq. ID no. 13491861
YQSHHQQSSSLFLQSLAPPQGTKNKVASSSSPSSCAPAYSLMEIHHNEIVAGGINPCSSSSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 60 - protein, 286 aa, Arabidopsis thaliana
  VARIANT (1)...(286): Ceres Seq. ID no. 13491862
MEIHHNEIVAGGINPCSSSSSSASVKAKIMAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 61 - protein, 257 aa, Arabidopsis thaliana
  VARIANT (1)...(257): Ceres Seq. ID no. 13491863
MAHPHYHRLLAAYVNCQKVGAPPEVVARLEEACSSAAAAAASMGPTGCLGEDPGLDQFMEAYCEMLVKYEQELSKPFKEAMVFLQRVECQFKSLSLSSPSSFSGYGETAIDRNNNGSSEEEVDMNNEFVDPQAEDRELKGQLLRKYSGYLGSLKQEFMKKRKKGKLPKEARQQLLDWWSRHYKWPYPSEQQKLALAESTGLDQKQINNWFINQRKRHWKPSEDMQFVVMDATHPHHYFMDNVLGNPFPMDHISSTML

SEQ ID NO: 62 - DNA, 687 bp, Arabidopsis thaliana
  misc_feature (1)...(687): Ceres Seq. ID no. 12325410
atcagaaaacaggaataaaagcactcaaaagtcaaagcgcgcgcgcgcacacacacacaaaaaacaatccaaagctaattgattcatcaatggcgatgtcgggaacatacgtgacggatgtgcctcttaagggatcggcggagaaacactataagaggtggaggagcgagaaccacctcgtccctgaagctatcggccacctcatccaaggtgtcaccgtccatgacggcgattgggactctcacggcaccatcaaaatctggaactacactcgtgatgggaaagaggaagtattgaaggagaggatagagatggacgacgagaatatggcggtgacgatcaatggactcgatggtcacgtcatggaggtcctcaaggtttatgtcacgacgttacatttcatccccgagtccaaagatggctgcgtctgcaaaattactatggtctgggagaaacgcaccgaagactccccagagcccatcgaattcatgaagttcgtggaacagatgattgctcacatggacgaccacatcctccaaaaccaggaatgatggatcgatgcttaatcatcatcacatcctccttttatttatcttaattaatgtgtgtccatctcgtacatgatattaatatcatcatggtgttgtatgtccaacgtttatttataaaagtattgttgttcgtttc

SEQ ID NO: 63 - protein, 182 aa, Arabidopsis thaliana
  VARIANT (1)...(182): Ceres Seq. ID no. 12325411
QKTGIKALKSQSARAHTHTKNNPKLIDSSMAMSGTYVTDVPLKGSAEKHYKRWRSENHLVPEAIGHLIQGVTVHDGDWDSHGTIKIWNYTRDGKEEVLKERIEMDDENMAVTINGLDGHVMEVLKVYVTTLHFIPESKDGCVCKITMVWEKRTEDSPEPIEFMKFVEQMIAHMDDHILQNQE

SEQ ID NO: 64 - protein, 153 aa, Arabidopsis thaliana
  VARIANT (1)...(153): Ceres Seq. ID no. 12325412
MAMSGTYVTDVPLKGSAEKHYKRWRSENHLVPEAIGHLIQGVTVHDGDWDSHGTIKIWNYTRDGKEEVLKERIEMDDENMAVTINGLDGHVMEVLKVYVTTLHFIPESKDGCVCKITMVWEKRTEDSPEPIEFMKFVEQMIAHMDDHILQNQE

SEQ ID NO: 65 - protein, 151 aa, Arabidopsis thaliana
  VARIANT (1)...(151): Ceres Seq. ID no. 12325413
MSGTYVTDVPLKGSAEKHYKRWRSENHLVPEAIGHLIQGVTVHDGDWDSHGTIKIWNYTRDGKEEVLKERIEMDDENMAVTINGLDGHVMEVLKVYVTTLHFIPESKDGCVCKITMVWEKRTEDSPEPIEFMKFVEQMIAHMDDHILQNQE

SEQ ID NO: 66 - DNA, 602 bp, Arabidopsis thaliana
  misc_feature (1)...(602): Ceres Seq. ID no. 12561621
agagtttcttccatctctcgctctttcgattttggagatatttacaggtacgcttgcttttcccttcacaacatcttcttcttcctgctcctctgtttcaaattccgaaaatcagataaaaaatgggagcttcgaaactttccgggatgcaaaagcaagtcttgagtctctacagaggatttctaagagcagctcgttcaagaccaatagaagacaggaagagaatagagatgattgtgtcaacagagttccgccacaactctaaggaggtcgaccgtaagaattttcagtacatcgagtatttgcttcggttaggtactaaacagcttgatcaactcaaaagccctgccatagttagcctctcctcgatcaaggtcgttacatctaaaacctgataccttattttatagcttgttgctctagtgaccatagataacaaagctgaggaaattgattcgttttcctctttttacattgagttatgtatgtatgatgatggatgttcaaggtccattataaaataaagagaattgtgatcacaattgaatatatatatacactttcacacaattatgtgcatctgctaatagtctagagattgc

SEQ ID NO: 67 - protein, 90 aa, Arabidopsis thaliana
  VARIANT (1)...(90): Ceres Seq. ID no. 12561622
MGASKLSGMQKQVLSLYRGFLRAARSRPIEDRKRIEMIVSTEFRHNSKEVDRKNFQYIEYLLRLGTKQLDQLKSPAIVSLSSIKVVTSKT

SEQ ID NO: 68 - protein, 87 aa, Arabidopsis thaliana
  VARIANT (1)...(87): Ceres Seq. ID no. 12561623
EFLPSLALSILEIFTGTLAFPFTTSSSSCSSVSNSENQIKNGSFETFRDAKASLESLQRISKSSSFKTNRRQEENRDDCVNRVPPQL

SEQ ID NO: 69 - protein, 82 aa, Arabidopsis thaliana
  VARIANT (1)...(82): Ceres Seq. ID no. 12561624
MQKQVLSLYRGFLRAARSRPIEDRKRIEMIVSTEFRHNSKEVDRKNFQYIEYLLRLGTKQLDQLKSPAIVSLSSIKVVTSKT

SEQ ID NO: 70 - DNA, 763 bp, Arabidopsis thaliana
  misc_feature (1)...(763): Ceres Seq. ID no. 12422873
aaaaaaacacaatccctcttagaaacagagagcttctcttctttctccattattcatcactttcttccccgaagatgcgtcctttagacgagaccgagacaaccgtcgtcttcgagaagctcttcaaattcgtcggcaacaacctcaagaagatcgtcgagaacccatcagacgaaggacccgaatctacacccggcagctactgcttccgcctccagaaaaacagagtctactacgtcagcgaagccctcgtgaagcgagccacaaacatctccaggaaaaacctagtctccttcggaacctgcatcgggaaatacactcacgccggtagtttccatctgacgattatgtcactcaatatcttggcggcgaatgctaaacacaaggtatggcttaaacccacttcggagatgtcgtttctttatgggaaccatgtcttgaaaggtggattagggaggattactgatagtattgttcctggagatggtgttgttgtgttctcgatgtctgatgttccgttagggtttgggattgctgcgaagagtacacaggattgtaggaaattggatcctaatggtattgttgtgcttcatcaggctgatattggagagtatttgaggggtgaagatgacctttgaaagtttaaaggttttgtctttgttgtgtcttagtttgattctgcttgttgctttgagttttaaagtatgtagctgttacaagtttcgtggaacttggttctggatctatgaaagtctcgattttt

SEQ ID NO: 71 - protein, 211 aa, Arabidopsis thaliana
  VARIANT (1)...(211): Ceres Seq. ID no. 12422874
KNTIPLRNRELLFFLHYSSLSSPKMRPLDETETTVVFEKLFKFVGNNLKKIVENPSDEGPESTPGSYCFRLQKNRVYYVSEALVKRATNISRKNLVSFGTCIGKYTHAGSFHLTIMSLNILAANAKHKVWLKPTSEMSFLYGNHVLKGGLGRITDSIVPGDGVVVFSMSDVPLGFGIAAKSTQDCRKLDPNGIVVLHQADIGEYLRGEDDL

SEQ ID NO: 72 - protein, 187 aa, Arabidopsis thaliana
  VARIANT (1)...(187): Ceres Seq. ID no. 12422875
MRPLDETETTVVFEKLFKFVGNNLKKIVENPSDEGPESTPGSYCFRLQKNRVYYVSEALVKRATNISRKNLVSFGTCIGKYTHAGSFHLTIMSLNILAANAKHKVWLKPTSEMSFLYGNHVLKGGLGRITDSIVPGDGVVVFSMSDVPLGFGIAAKSTQDCRKLDPNGIVVLHQADIGEYLRGEDDL

SEQ ID NO: 73 - DNA, 851 bp, Arabidopsis thaliana
  misc_feature (1)...(851): Ceres Seq. ID no. 12393506
ataagatcttctttaaaatccaaaatcgtaggccactatttcattatacttatgtaatatatgtgatacagatacatctatatacaaattaaacacgaaaccatacatgcacggtgtgatcacacacgcacacacatagaaacataaacacgcaataatttctatacagtttaatttcatttttaacttacttctttttttttggtgaagattcttgagagaaaagaaatcgaagatggcaacaaaatccaccggaggtaccgagaaaaccaagtcgatagaagtgaagaagaaactaatcaacgtgttgatcgtcgatgatgatccattaaaccgtagactccacgagatgatcatcaaaacgatcggaggaatttctcagactgcaaagaatggcgaggaggcagtgatcctccaccgtgacggcgaagcatctttcgaccttattctaatggataaggaaatgcctgagagggatggagtttcgacaactaagaagctaagagaaatgaaagtgacgtcaatgatcgttggggtaacgtcattagctgaccaagaagaagagcgtaaggcttttatggaagctgggctcaaccattgcttggaaaaacccttaaccaaggccaagatcttcccgctcattagccacctcttcgatgcttgatggatgaaggctcattaatgtatctatattttcaatcatgaaatcacctacacgtgtatttgacacaaaaatctgcatttgttgtgatatagggtttctcatatctatgtttgatttattttcttatcgtccgaggtaaaatcatgcaagtcatttcttttggctaataaaatattaaaataagggc

SEQ ID NO: 74 - protein, 142 aa, Arabidopsis thaliana
  VARIANT (1)...(142): Ceres Seq. ID no. 12393507
MATKSTGGTEKTKSIEVKKKLINVLIVDDDPLNRRLHEMIIKTIGGISQTAKNGEEAVILHRDGEASFDLILMDKEMPERDGVSTTKKLREMKVTSMIVGVTSLADQEEERKAFMEAGLNHCLEKPLTKAKIFPLISHLFDA

SEQ ID NO: 75 - protein, 104 aa, Arabidopsis thaliana
  VARIANT (1)...(104): Ceres Seq. ID no. 12393508
MIIKTIGGISQTAKNGEEAVILHRDGEASFDLILMDKEMPERDGVSTTKKLREMKVTSMIVGVTSLADQEEERKAFMEAGLNHCLEKPLTKAKIFPLISHLFDA

SEQ ID NO: 76 - DNA, 834 bp, Arabidopsis thaliana
  misc_feature (1)...(834): Ceres Seq. ID no. 12332848
ttccactttaaatcaggaacaaacccttcactgcgccagtgttgtgcggctctgcgaatcttcgaaaatgggtgcgtacaagtatgtatctgagctatggaggaagaaacagtccgatgtgatgagattcctccagagggttaggtgctgggagtacagacagcaaccttcgattgttcgtctcgtcaggcctactcgtcctgataaggctcgtcgtttgggttacaaggccaagcagggctttgttgtgtaccgtgtacgtgtgagacgtggtggacgcaagaggccagtgcctaagggtattgtgtatggtaagccaacaaaccagggagtgacacaactcaagttccagcgtagcaagcgttctgttgctgaggagcgtgctggcaggaaattgggtggtctcagagttgtcaactcttactggctcaatgaggattcgacctacaagtactacgagatcatcttggttgacccagcacacaatgctgtgcgtaatgacccgagaatcaactggatctgcaacccagttcacaagcaccgtgagctcagaggacttacctcagagggaaagaagaacagaggtctccgcggaaagggtcacaacaaccacaagaaccgtccatctcgcagggctacatggaagaaaaacaactctctcagccttcgtcgttaccgttgattgccttttgcttttattattactgttatcatcttctaggttccatgttgttgcacttttatctctctcaggatgacttgtttttgcaaattttggagactatacaattatgctttgaacctaaattttatatttgctttgcttttttgtcg

SEQ ID NO: 77 - protein, 226 aa, Arabidopsis thaliana
  VARIANT (1)...(226): Ceres Seq. ID no. 12332849
STLNQEQTLHCASVVRLCESSKMGAYKYVSELWRKKQSDVMRFLQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 78 - protein, 204 aa, Arabidopsis thaliana
  VARIANT (1)...(204): Ceres Seq. ID no. 12332850
MGAYKYVSELWRKKQSDVMRFLQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 79 - protein, 186 aa, Arabidopsis thaliana
  VARIANT (1)...(186): Ceres Seq. ID no. 12332851
MRFLQRVRCWEYRQQPSIVRLVRPTRPDKARRLGYKAKQGFVVYRVRVRRGGRKRPVPKGIVYGKPTNQGVTQLKFQRSKRSVAEERAGRKLGGLRVVNSYWLNEDSTYKYYEIILVDPAHNAVRNDPRINWICNPVHKHRELRGLTSEGKKNRGLRGKGHNNHKNRPSRRATWKKNNSLSLRRYR

SEQ ID NO: 80 - DNA, 1794 bp, Arabidopsis thaliana
  misc_feature (1)...(1794): Ceres Seq. ID no. 12558789
ctcagcagcttcttctgctttcaattactctcgccgacgattttctcaccggaaaaaaacaatatcattgcggatacacaaactataatggacctcctcttgctggagaagtctttaatcgccgtcttcgtggcggtgattctcgccacggtgatttcaaagctccgcggcaagaaattgaagctacctccaggtcctataccaattccgatcttcggaaactggcttcaagtcggagatgatctcaaccaccgtaatctcgtcgattacgctaagaaattcggcgatctcttcctcctccgtatgggtcagcgaaacctagtcgtcgtctcctcaccggatctaacaaaggaagtgctcctcactcaaggcgttgagtttggatccagaacgagaaacgtcgtgttcgacattttcaccgggaaaggtcaagatatggtgttcactgtttacggcgagcattggaggaagatgagaagaatcatgacggttcctttcttcaccaacaaagttgttcaacagaatcgtgaaggttgggagtttgaagcagctagtgttgttgaagatgttaagaagaatccagattctgctacgaaaggaatcgtgttgaggaaacgtttgcaattgatgatgtataacaatatgttccgtatcatgttcgatagaagatttgagagtgaggatgatcctcttttccttaggcttaaggctttgaatggtgagagaagtcgattagctcagagctttgagtataactatggagatttcattcctatccttagaccattcctcagaggctatttgaagatttgtcaagatgtgaaagatcgaagaatcgctcttttcaagaagtactttgttgatgagaggaagcaaattgcgagttctaagcctacaggtagtgaaggattgaaatgtgccattgatcacatccttgaagctgagcagaagggagaaatcaacgaggacaatgttctttacatcgtcgagaacatcaatgtcgccgcgattgagacaacattgtggtctatcgagtggggaattgcagagctagtgaaccatcctgaaatccagagtaagctaaggaacgaactcgacacagttcttggaccgggtgtgcaagtcaccgagcctgatcttcacaaacttccataccttcaagctgtggttaaggagactcttcgtctgagaatggcgattcctctcctcgtgcctcacatgaacctccatgatgcgaagctcgctggctacgatatcccagcagaaagcaaaatccttgttaatgcttggtggctagcaaacaaccccaacagctggaagaagcctgaagagtttagaccagagaggttctttgaagaagaatcgcacgtggaagctaacggtaatgacttcaggtatgtgccatttggtgttggacgtcgaagctgtcccgggattatattggcattgcctattttggggatcaccattggtaggatggtccagaacttcgagcttcttcctcctccaggacagtctaaagtggatactagtgagaaaggtggacaattcagcttgcacatccttaaccactccataatcgttatgaaaccaaggaactgttaaactttctgcacaaaaaaaaggatgaagatgactttataaatgtttgtgaaatctgttgaaatattcccttgttttgcttttgtgagatgtttttgtgtaaaatgtctttaaatggttcgttctacgattgcaataataattagtggtgctcattgttttggatggatcaatgttatacttatatcattt

SEQ ID NO: 81 - protein, 534 aa, Arabidopsis thaliana
  VARIANT (1)...(534): Ceres Seq. ID no. 12558790
LSSFFCFQLLSPTIFSPEKNNIIADTQTIMDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 82 - protein, 505 aa, Arabidopsis thaliana
  VARIANT (1)...(505): Ceres Seq. ID no. 12558791
MDLLLLEKSLIAVFVAVILATVISKLRGKKLKLPPGPIPIPIFGNWLQVGDDLNHRNLVDYAKKFGDLFLLRMGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 83 - protein, 433 aa, Arabidopsis thaliana
  VARIANT (1)...(433): Ceres Seq. ID no. 12558792
MGQRNLVVVSSPDLTKEVLLTQGVEFGSRTRNVVFDIFTGKGQDMVFTVYGEHWRKMRRIMTVPFFTNKVVQQNREGWEFEAASVVEDVKKNPDSATKGIVLRKRLQLMMYNNMFRIMFDRRFESEDDPLFLRLKALNGERSRLAQSFEYNYGDFIPILRPFLRGYLKICQDVKDRRIALFKKYFVDERKQIASSKPTGSEGLKCAIDHILEAEQKGEINEDNVLYIVENINVAAIETTLWSIEWGIAELVNHPEIQSKLRNELDTVLGPGVQVTEPDLHKLPYLQAVVKETLRLRMAIPLLVPHMNLHDAKLAGYDIPAESKILVNAWWLANNPNSWKKPEEFRPERFFEEESHVEANGNDFRYVPFGVGRRSCPGIILALPILGITIGRMVQNFELLPPPGQSKVDTSEKGGQFSLHILNHSIIVMKPRNC

SEQ ID NO: 84 - DNA, 1057 bp, Arabidopsis thaliana
  misc_feature (1)...(1057): Ceres Seq. ID no. 12738854
gtttttgggattctcaaaaaactcaaaataaactttcctcattttttttttctttcttttgttttgttttctttataaaggagaaagaaagagaaagagagtttccgaaagctgaattgagttgggtgaagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttctagttgaaatcgaaaacgcgcagaaaagggagattgagcttgacaatgagaacatctatctaagaactaaggtagcagaagtggagaggtatcaacaacaccatcatcaaatggttagtggttcagagattaacgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgtatcatagtatctattctatggtatctcc

SEQ ID NO: 85 - protein, 277 aa, Arabidopsis thaliana
  VARIANT (1)...(277): Ceres Seq. ID no. 12738855
FWDSQKTQNKLSSFFFSFFCFVFFIKEKEREREFPKAELSWVKQILRMGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 86 - protein, 230 aa, Arabidopsis thaliana
  VARIANT (1)...(230): Ceres Seq. ID no. 12738856
MGRGKIEIKRIENSTNRQVTFCKRRNGLLKKAYELSVLCDAEVALIVFSTRGRLYEYANNNIRSTIERYKKACSDSTNTSTVQEINAAYYQQESAKLRQQIQTIQNSNRNLMGDSLSSLSVKELKQVENRLEKAISRIRSKKHELLLVEIENAQKREIELDNENIYLRTKVAEVERYQQHHHQMVSGSEINAIEALASRNYFAHSIMTAGSGSGNGGSYSDPDKKILHLG

SEQ ID NO: 87 - DNA, 1623 bp, Arabidopsis thaliana
  misc_feature (1)...(1623): Ceres Seq. ID no. 13487143
ccgagattacagagaaccccgtcccgtgtttaaaccctccggcgacaaagctcagatagagaaccgctccacccttgtcgttctctgcagccatgtacggcggagatgaagtgtcagctattgtggttgacttgggttcgcacacttgcaaggctggttacgccggtgaagatgctcccaaggccgttttcccttccgttattggggcagtagatggtgtagaggcaatggatgtggatgttgattctacaaagactaattcgaactctgaggattcgaagaccgagtctgaaaaggaaaagggcaaacgcaagctctatgtaggatctcaagccatgagctaccgcagagatcatatggaggttttgtcacctataaaagatggcatcgtttctgactgggatttggtggacaatatatgggaacatgctttcaagagttgtctgatgattgatcctacggagcatccaatgctgctagctgagcctcctttaaacactcaacagcagagagagaaggcggcagagctaatgtttgaaaagtacaaagttccggcactgtttatggctaagaaccctgttctcacgtcttttgctactgggcgtgctacttctttggttgttgactgcggtggaggatccacaaccatttcaccggtgcatgatggttatgttcttcagaaggctgttgtatcgtctccacttggaggggaatttctcactgactgcctactgaaaagcttggagagtaaaggaattaaaataagacctagatactctttcaagaggaaggaagtacgagcaggggaattccaggttgaagatgtggatattcctgacaccacggaaagctacaaactcttctgccagaggatgatagtgggtgatatcaaggattctatttgtcgagttcctgatactccctatgacgataaatcatattcaaacatccctactacgtcgtacgagcttcctgatggccagacgctcgagattggtgctgataggttcaaagttcctgatgtgatgttcaacccgtccatagtccagacgattcctggaatggagaagtatgctgatatgattccttccgttcgtgggttaccacacatggtcatggagagcatcaacaaatgtgatgtagacatccggagagagttgtatagtagcatactgcttgctggtggcacatcgtcaatgcaacagctgaaagaacgtctcgaaaaggacttgatcgaagagtctcctcactcagctagagttaaagtgttggcaagcggtaacacaacagaaagaagattcagtgtatggataggagggagtatattggcatcactaggctcatttcaacagatgtggttctccaagtctgagtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctatttttaaaacataaaaacatgtggaagaagtttcgttgctttattagattttcgc

SEQ ID NO: 88 - protein, 441 aa, Arabidopsis thaliana
  VARIANT (1)...(441): Ceres Seq. ID no. 13487144
MYGGDEVSAIVVDLGSHTCKAGYAGEDAPKAVFPSVIGAVDGVEAMDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 89 - protein, 396 aa, Arabidopsis thaliana
  VARIANT (1)...(396): Ceres Seq. ID no. 13487145
MDVDVDSTKTNSNSEDSKTESEKEKGKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 90 - protein, 360 aa, Arabidopsis thaliana
  VARIANT (1)...(360): Ceres Seq. ID no. 13487146
MSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYADMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 91 - DNA, 523 bp, Arabidopsis thaliana
  misc_feature (1)...(523): Ceres Seq. ID no. 12337118
atcaaggtaagacacttcgcttcaaatcatttgtgtattacagaaacttctgatcgtcatggaagctacttcacaaccatgtttctctcataactcctcacttcattcgacccgtaagcaaccggcaaacccatggaaaaaacccgtaacgggcttgcctcagaggatgcatcctaaagtttacagagtcgagcctgttaacttcaaggagttagttcagaggctaactggtgcagaagacgttgagcaagaggtacatcaagttgaagctaaaccagtcaagatttctgatgatacaacaacagctaaggataatccgttcgcgtttgatctttcaccttcgtcatctcggttctgggaagctttccctctgcttagtcctgctaatctatcaagatggtagcgagaaagaagctattcttgccaatttttcggcaattcatgaatttgtttcatcagaattagaactgtagtagtaacactttatgatcttatctttaaatacaaaagttactgttacatt

SEQ ID NO: 92 - protein, 114 aa, Arabidopsis thaliana
  VARIANT (1)...(114): Ceres Seq. ID no. 12337119
MEATSQPCFSHNSSLHSTRKQPANPWKKPVTGLPQRMHPKVYRVEPVNFKELVQRLTGAEDVEQEVHQVEAKPVKISDDTTTAKDNPFAFDLSPSSSRFWEAFPLLSPANLSRW

SEQ ID NO: 93 - protein, 78 aa, Arabidopsis thaliana
  VARIANT (1)...(78): Ceres Seq. ID no. 12337120
MHPKVYRVEPVNFKELVQRLTGAEDVEQEVHQVEAKPVKISDDTTTAKDNPFAFDLSPSSSRFWEAFPLLSPANLSRW

SEQ ID NO: 94 - protein, 60 aa, Arabidopsis thaliana
  VARIANT (1)...(60): Ceres Seq. ID no. 12337121
MIQQQLRIIRSRLIFHLRHLGSGKLSLCLVLLIYQDGSEKEAILANFSAIHEFVSSELEL

SEQ ID NO: 95 - DNA, 1081 bp, Arabidopsis thaliana
  misc_feature (1)...(1081): Ceres Seq. ID no. 12333219
attatcatatcctcttcttccttcttcactatcaatcttcttctccactacaacacaaatggagaaatcatcctcaatgaaacaatggaagaagggtcctgctcggggtaaaggcggtccacaaaacgctctttgtcagtaccgtggagtcaggcaaaggacttggggcaaatgggtggctgagatcagagagcccaagaagagggcaagactttggcttggctctttcgctacagctgaagaagcagctatggcttatgatgaggctgccttgaaactctatgggcacgacgcatacctcaacttacctcatcttcagcggaatacaagaccttctctgagtaactctcagaggttcaaatgggtaccttcaaggaagtttatatctatgtttccttcatgtggtatgctaaacgtgaatgctcagcctagtgttcacataatccagcaaagactagaagaactcaagaaaactggacttttatctcaatcctattcttctagttcttcctccaccgaatcaaaaactaatactagctttcttgatgagaagaccagcaagggagaaacagacaatatgttcgaaggtggtgatcagaagaaaccagagatcgacctgaccgagtttcttcagcaactaggaatcttgaaggatgaaaatgaagcagaaccaagtgaggtagcagagtgtcattcccctccaccatggaacgagcaagaagaaactggaagtcctttcagaactgagaatttcagctgggataccctgatcgagatgccaagaagtgaaaccacaactatgcaatttgactccagcaacttcggaagctatgattttgaggatgatgtatccttcccttccatctgggactactacggaagcttagattgagtaaaagcaatttaaggtagatcaagattcagaagtacacaaatggttttggatttagtgtagcgttttggaaaagagacataggtagtgagagtgcagtcttttattatgcagcaataaagtgagtcagtgtacaaccgagttgttcgctttttttggtatattaattaagcatgttcattttttcgc

SEQ ID NO: 96 - protein, 296 aa, Arabidopsis thaliana
  VARIANT (1)...(296): Ceres Seq. ID no. 12333220
LSYPLLPSSLSIFFSTTTQMEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 97 - protein, 277 aa, Arabidopsis thaliana
  VARIANT (1)...(277): Ceres Seq. ID no. 12333221
MEKSSSMKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 98 - protein, 271 aa, Arabidopsis thaliana
  VARIANT (1)...(271): Ceres Seq. ID no. 12333222
MKQWKKGPARGKGGPQNALCQYRGVRQRTWGKWVAEIREPKKRARLWLGSFATAEEAAMAYDEAALKLYGHDAYLNLPHLQRNTRPSLSNSQRFKWVPSRKFISMFPSCGMLNVNAQPSVHIIQQRLEELKKTGLLSQSYSSSSSSTESKTNTSFLDEKTSKGETDNMFEGGDQKKPEIDLTEFLQQLGILKDENEAEPSEVAECHSPPPWNEQEETGSPFRTENFSWDTLIEMPRSETTTMQFDSSNFGSYDFEDDVSFPSIWDYYGSLD

SEQ ID NO: 99 - DNA, 3591 bp, Arabidopsis thaliana
  misc_feature (1)...(3591): Ceres Seq. ID no. 12653917
atgaagactttttcaagcttctttctctctgtaacaactctcttcttcttctccttcttttctctttcatttcaagcttcaccatctcagtctttatacagagaaatccatcagcttataagcttcaaagacgttcttcctgacaagaatcttctcccagactggtcttccaacaaaaacccgtgtactttcgatggcgttacttgcagagacgacaaagttacttcgattgatctcagctccaagcctctcaacgtcggattcagtgccgtgtcctcgtctctcctgtctctcaccggattagagtctctgtttctctcaaactcacacatcaatggctccgtttctggcttcaagtgctctgcttctttaaccagcttggatctatctagaaactctctttcgggtcctgtaacgactctaacaagccttggttcttgctccggtctgaagtttcttaacgtctcttccaatacacttgattttcccgggaaagtttcaggtgggttgaagctaaacagcttggaagttctggatctttctgcgaattcaatctccggtgctaacgtcgttggttgggttctctccgatgggtgtggagagttgaaacatttagcgattagcggaaacaaaatcagtggagacgtcgatgtttctcgctgcgtgaatctcgagtttctcgatgtttcctccaacaatttctccactgggattcctttcctcggagattgctctgctctgcaacatcttgacatctccgggaacaaattatccggcgatttctcccgtgctatctctacttgcacagagctcaagttgttgaacatctctagtaaccaattcgtcggaccaatccctccgctaccgcttaaaagtctccaatacctctctctggccgagaacaaattcaccggcgagatccctgactttctctccggcgcgtgtgatacactcactggtctcgatctctctggaaatcatttctacggtgcggttcctccattcttcggttcatgttctcttctcgaatcactcgcgttgtcgagtaacaacttctctggcgagttaccgatggatacgttgttgaagatgagaggactcaaagtacttgatctgtctttcaacgagttttccggcgaattaccggaatctctgacgaatctatccgcttcgttgctaacgttagatctcagctccaacaatttctccggtccgattctcccaaatctctgccagaaccctaaaaacactctgcaggagctttaccttcagaacaatggcttcaccgggaagattccaccgactttaagcaactgttctgagctggtttcgcttcacttgagcttcaattacctctccgggacaatcccttcgagcttaggctctctatcgaagcttcgagatctgaaactatggctgaatatgttagaaggagagatccctcaggagctcatgtatgtcaagaccttagagactctgatcctcgacttcaacgatttaaccggtgaaatcccttccggtttaagtaactgtaccaatcttaactggatttctctgtcgaataaccggttaaccggtgagattccgaaatggattggccggttagagaatctcgctatcctcaagctaagcaacaattcattctccgggaacattccggctgagctcggcgactgcagaagcttaatctggcttgatctcaacaccaatctcttcaatggaacgattccggcggcgatgtttaaacaatccgggaaaatcgctgccaatttcatcgccggtaagaggtacgtttatatcaaaaacgatgggatgaagaaagagtgtcatggagctggtaatttacttgagtttcaaggaatcagatccgaacaattaaaccggctttcaacgaggaacccttgtaatatcactagcagagtctatggaggtcacacttcgccgacgtttgataacaatggttcgatgatgtttctggacatgtcttacaacatgttgtctggatacataccgaaggagattggttcgatgccttatctgtttattctcaatttgggtcataacgatatctctggttcgattcctgatgaggtaggtgatctaagaggtttaaacattcttgatctttcaagcaataagctcgatgggaggattcctcaggctatgtcagctcttactatgcttacggaaatcgatttgtcgaataataatttgtctggtccgattcctgagatgggtcagtttgagacttttccaccggctaagttcttgaacaatcctggtctctgtggttatcctcttccgcggtgtgatccttcaaatgcagacggttatgctcatcatcagagatctcatggaaggagaccagcgtcccttgctggtagtgtggcgatgggattgttgttctcttttgtgtgtatatttgggctgatccttgttggtagagagatgaggaagagacggagaaagaaagaggcggagttggagatgtatgcggaaggacatggaaactctggcgatagaactgctaacaacaccaattggaagctgactggtgtgaaagaagccttgagtatcaatcttgctgctttcgagaagccattgcggaagctcacgtttgcggatcttcttcaggctaccaatggtttccataatgatagtctgattggttctggtgggtttggagatgtttacaaagcgattttgaaagatggaagcgcggtggctatcaagaaactgattcatgttagcggtcaaggtgatagagagttcatggcggagatggaaaccattgggaagatcaaacatcgaaatcttgtgcctcttcttggttattgcaaagttggagacgagcggcttcttgtgtatgagtttatgaagtatggaagtttagaagatgttttgcacgaccccaagaaagctggggtgaaactaaactggtccacacggcggaagattgcgataggatcagctagagggcttgctttccttcaccacaactgcagtccgcatatcatccacagagacatgaaatccagtaatgtgttgcttgatgagaatttggaagctcgggtttcagattttggcatggcgaggctgatgagtgcgatggatacgcatttaagcgtcagtacattagctggtacaccgggttacgttcctccagagtattaccaaagtttcaggtgttcaacaaaaggagacgtttatagttacggtgtggtcttactcgagctactcacgggtaaacggccaacggattcaccggattttggagataacaaccttgttggatgggtgaaacagcacgcaaaactgcggattagcgatgtgtttgaccccgagcttatgaaggaagatccagcattagagatcgaacttttacaacatttaaaagttgcggttgcgtgtttggatgatcgggcttggagacgaccgacaatggtacaagtcatggccatgtttaaggagatacaagccgggtcagggatagattcacagtcaacgatcagatcaatagaggatggagggttcagtacaatagagatggttgatatgagtataaaagaagttcctgaaggaaaattatga

SEQ ID NO: 100 - protein, 1196 aa, Arabidopsis thaliana
  VARIANT (1)...(1196): Ceres Seq. ID no. 12653918
MKTFSSFFLSVTTLFFFSFFSLSFQASPSQSLYREIHQLISFKDVLPDKNLLPDWSSNKNPCTFDGVTCRDDKVTSIDLSSKPLNVGFSAVSSSLLSLTGLESLFLSNSHINGSVSGFKCSASLTSLDLSRNSLSGPVTTLTSLGSCSGLKFLNVSSNTLDFPGKVSGGLKLNSLEVLDLSANSISGANVVGWVLSDGCGELKHLAISGNKISGDVDVSRCVNLEFLDVSSNNFSTGIPFLGDCSALQHLDISGNKLSGDFSRAISTCTELKLLNISSNQFVGPIPPLPLKSLQYLSLAENKFTGEIPDFLSGACDTLTGLDLSGNHFYGAVPPFFGSCSLLESLALSSNNFSGELPMDTLLKMRGLKVLDLSFNEFSGELPESLTNLSASLLTLDLSSNNFSGPILPNLCQNPKNTLQELYLQNNGFTGKIPPTLSNCSELVSLHLSFNYLSGTIPSSLGSLSKLRDLKLWLNMLEGEIPQELMYVKTLETLILDFNDLTGEIPSGLSNCTNLNWISLSNNRLTGEIPKWIGRLENLAILKLSNNSFSGNIPAELGDCRSLIWLDLNTNLFNGTIPAAMFKQSGKIAANFIAGKRYVYIKNDGMKKECHGAGNLLEFQGIRSEQLNRLSTRNPCNITSRVYGGHTSPTFDNNGSMMFLDMSYNMLSGYIPKEIGSMPYLFILNLGHNDISGSIPDEVGDLRGLNILDLSSNKLDGRIPQAMSALTMLTEIDLSNNNLSGPIPEMGQFETFPPAKFLNNPGLCGYPLPRCDPSNADGYAHHQRSHGRRPASLAGSVAMGLLFSFVCIFGLILVGREMRKRRRKKEAELEMYAEGHGNSGDRTANNTNWKLTGVKEALSINLAAFEKPLRKLTFADLLQATNGFHNDSLIGSGGFGDVYKAILKDGSAVAIKKLIHVSGQGDREFMAEMETIGKIKHRNLVPLLGYCKVGDERLLVYEFMKYGSLEDVLHDPKKAGVKLNWSTRRKIAIGSARGLAFLHHNCSPHIIHRDMKSSNVLLDENLEARVSDFGMARLMSAMDTHLSVSTLAGTPGYVPPEYYQSFRCSTKGDVYSYGVVLLELLTGKRPTDSPDFGDNNLVGWVKQHAKLRISDVFDPELMKEDPALEIELLQHLKVAVACLDDRAWRRPTMVQVMAMFKEIQAGSGIDSQSTIRSIEDGGFSTIEMVDMSIKEVPEGKL

SEQ ID NO: 101 - protein, 839 aa, Arabidopsis thaliana
  VARIANT (1)...(839): Ceres Seq. ID no. 12653919
MDTLLKMRGLKVLDLSFNEFSGELPESLTNLSASLLTLDLSSNNFSGPILPNLCQNPKNTLQELYLQNNGFTGKIPPTLSNCSELVSLHLSFNYLSGTIPSSLGSLSKLRDLKLWLNMLEGEIPQELMYVKTLETLILDFNDLTGEIPSGLSNCTNLNWISLSNNRLTGEIPKWIGRLENLAILKLSNNSFSGNIPAELGDCRSLIWLDLNTNLFNGTIPAAMFKQSGKIAANFIAGKRYVYIKNDGMKKECHGAGNLLEFQGIRSEQLNRLSTRNPCNITSRVYGGHTSPTFDNNGSMMFLDMSYNMLSGYIPKEIGSMPYLFILNLGHNDISGSIPDEVGDLRGLNILDLSSNKLDGRIPQAMSALTMLTEIDLSNNNLSGPIPEMGQFETFPPAKFLNNPGLCGYPLPRCDPSNADGYAHHQRSHGRRPASLAGSVAMGLLFSFVCIFGLILVGREMRKRRRKKEAELEMYAEGHGNSGDRTANNTNWKLTGVKEALSINLAAFEKPLRKLTFADLLQATNGFHNDSLIGSGGFGDVYKAILKDGSAVAIKKLIHVSGQGDREFMAEMETIGKIKHRNLVPLLGYCKVGDERLLVYEFMKYGSLEDVLHDPKKAGVKLNWSTRRKIAIGSARGLAFLHHNCSPHIIHRDMKSSNVLLDENLEARVSDFGMARLMSAMDTHLSVSTLAGTPGYVPPEYYQSFRCSTKGDVYSYGVVLLELLTGKRPTDSPDFGDNNLVGWVKQHAKLRISDVFDPELMKEDPALEIELLQHLKVAVACLDDRAWRRPTMVQVMAMFKEIQAGSGIDSQSTIRSIEDGGFSTIEMVDMSIKEVPEGKL

SEQ ID NO: 102 - protein, 833 aa, Arabidopsis thaliana
  VARIANT (1)...(833): Ceres Seq. ID no. 12653920
MRGLKVLDLSFNEFSGELPESLTNLSASLLTLDLSSNNFSGPILPNLCQNPKNTLQELYLQNNGFTGKIPPTLSNCSELVSLHLSFNYLSGTIPSSLGSLSKLRDLKLWLNMLEGEIPQELMYVKTLETLILDFNDLTGEIPSGLSNCTNLNWISLSNNRLTGEIPKWIGRLENLAILKLSNNSFSGNIPAELGDCRSLIWLDLNTNLFNGTIPAAMFKQSGKIAANFIAGKRYVYIKNDGMKKECHGAGNLLEFQGIRSEQLNRLSTRNPCNITSRVYGGHTSPTFDNNGSMMFLDMSYNMLSGYIPKEIGSMPYLFILNLGHNDISGSIPDEVGDLRGLNILDLSSNKLDGRIPQAMSALTMLTEIDLSNNNLSGPIPEMGQFETFPPAKFLNNPGLCGYPLPRCDPSNADGYAHHQRSHGRRPASLAGSVAMGLLFSFVCIFGLILVGREMRKRRRKKEAELEMYAEGHGNSGDRTANNTNWKLTGVKEALSINLAAFEKPLRKLTFADLLQATNGFHNDSLIGSGGFGDVYKAILKDGSAVAIKKLIHVSGQGDREFMAEMETIGKIKHRNLVPLLGYCKVGDERLLVYEFMKYGSLEDVLHDPKKAGVKLNWSTRRKIAIGSARGLAFLHHNCSPHIIHRDMKSSNVLLDENLEARVSDFGMARLMSAMDTHLSVSTLAGTPGYVPPEYYQSFRCSTKGDVYSYGVVLLELLTGKRPTDSPDFGDNNLVGWVKQHAKLRISDVFDPELMKEDPALEIELLQHLKVAVACLDDRAWRRPTMVQVMAMFKEIQAGSGIDSQSTIRSIEDGGFSTIEMVDMSIKEVPEGKL

SEQ ID NO: 103 - DNA, 1267 bp, Glycine max
  misc_feature (1)...(1267): Ceres Seq. ID no. 12431631
ggagtacacagtcaataacggtcacatgcgctttgctacttctctaaacgtgaaaacatttacaccaacctacactccttgctcctacatatcccgcgccttacatgcagttccaagtatcaccaaaccaagcagtgtgatactcatactcagtactcacagcaccactttcaagtgttcaaagttcaactatcccaatatcaacgaaccatggatacttgcaagaagtcccctttgaagccatggaagaaagggccaacaagggggaaaggcgggccccagaacgcctcctgcgagtaccgaggcgttcggcagcgaacttggggcaaatgggttgctgagataagagagccaaagaagagaaccaggctctggcttggttcttttgccacagctgaagaagctgccatggcttatgatgaggctgctaggagactctatggtccagatgcataccttaatctcccccacctgcaacccaggtccacttcaactatcacgtcaggaaagttcaaatggttcccttccaagaacttcatttcaatgtttccttcctgtggattactcaatgtaaatgctcaacctagtgttcatttaatccatcagaggctgcaagagcttaagcgaaattcagttgtgagtcaatcctcatctagttcatccaatgatccaaaggcagaaattcagaatgtagacagcaaaaatcacggagaagatgaaaatcctccaaaagatgttcaaacatcatcagaggaggtgcttggagatcttcaggagaaaccccagatagacctccatgagtttcttcaacagatgggaatacttaaagaagaaagacagtcagaaagaactgatagctcaggaagttcaacagtgcgtgaagctgtgttgacagatgactgtgatcatttgggagtgttttctgacaagagtgttaactgggaggcattgattgagatgcatggacttgcaggtattcaggaatcagaagtcactcagcttgaagcatatgagccaaatgatgatctaactttctcaacttccatttggaacttttaagaaacttagcatataagcctaagcaatagatcacaaggttttggttatccaactactctagtcctgtatatgtctgcagcatttcaatctgtcggcagcactgtaagagtaagaaagtagctagaatagaagactactagtgagaaaggagcttatttcagtagttgtgacagcaaatggagaaaataatatcagtctgcgtattatt

SEQ ID NO: 104 - protein, 282 aa, Glycine max
  VARIANT (1)...(282): Ceres Seq. ID no. 12431632
MDTCKKSPLKPWKKGPTRGKGGPQNASCEYRGVRQRTWGKWVAEIREPKKRTRLWLGSFATAEEAAMAYDEAARRLYGPDAYLNLPHLQPRSTSTITSGKFKWFPSKNFISMFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 105 - protein, 216 aa, Glycine max
  VARIANT (2)...(216): Ceres Seq. ID no. 12431633
MAYDEAARRLYGPDAYLNLPHLQPRSTSTITSGKFKWFPSKNFISMFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 106 - protein, 171 aa, Glycine max
  VARIANT (1)...(171): Ceres Seq. ID no. 12431634
MFPSCGLLNVNAQPSVHLIHQRLQELKRNSVVSQSSSSSSNDPKAEIQNVDSKNHGEDENPPKDVQTSSEEVLGDLQEKPQIDLHEFLQQMGILKEERQSERTDSSGSSTVREAVLTDDCDHLGVFSDKSVNWEALIEMHGLAGIQESEVTQLEAYEPNDDLTFSTSIWNF

SEQ ID NO: 107 - DNA, 728 bp, Glycine max
  misc_feature (1)...(728): Ceres Seq. ID no. 12447176
acatgcaacttgtcttaatttctttctcgatccccaacatcactagctagctccttttgtacacactctacaaccccacctagctacatcacttaattagttttcccatatctataaccaatttcaaattctcacccttaactagctagctatatttcataactgattattaccaactcactacatattattggctaggattcaccattagacttaaaagtagttgatttattatatatataagatgtctagcaggaggtcacggtcaaggcaaacaagtagttcaaggaatatcaccgatgatcagatcaatgatcttgtctccaagttgcaacagcttcttccagagattcgcgataggcgctctgacaaggtttcagcttccaaggtgttgcaagagacatgcaactatattagaagcttacacagggaagtggatgacctaagcgagcgtttatctgagctcttggctacaactgacacagcacaagctgcaataattagaaatctactaatgcaatagatcggtgcagtagttaatttatcgcataattcatagttagcacttcagtacttgtgaaccgatccagtcagtagtcgcgtatttcttattctctttttgtttcactttttttttctggtttttgtccactaatatgcatgattactgcttttgcaaagcccattttcctaagatattaaataaaagtctgagtttgcgctttgct

SEQ ID NO: 108 - protein, 92 aa, Glycine max
  VARIANT (1)...(92): Ceres Seq. ID no. 12447177
MSSRRSRSRQTSSSRNITDDQINDLVSKLQQLLPEIRDRRSDKVSASKVLQETCNYIRSLHREVDDLSERLSELLATTDTAQAAIIRNLLMQ

SEQ ID NO: 109 - protein, 48 aa, Glycine max
  VARIANT (1)...(48): Ceres Seq. ID no. 12447178
MIRSMILSPSCNSFFQRFAIGALTRFQLPRCCKRHATILEAYTGKWMT

SEQ ID NO: 110 - DNA, 1750 bp, Glycine max
  misc_feature (1)...(1750): Ceres Seq. ID no. 12446037
aattttctttcttcaaatctcgcgcgctcctcacttcgagtgttcgactttcctcctccgaccacctcgccgggaattcccgcggcggcgctccttgtctccgcagcttctctctctactgaagccctagagagagaaaatcataaaccctaattcccctgtcaagctcgtagcacagtcacagccatgtatggcggtgatgaagtatcagctatagtaattgacttgggttcacacacttgtaaagctggttatgccggtgaagatgctcccaaggctgtgtttccctctgttgttggagcaattgatcaaatggatgttgatgaagcagataatggtgaaaagaaccctggctctgctccggaatcaaataataataatgttagaaatgctgattctgacaaggccaagggaaagaggaaattgtatgtaggatcccagtccttggggtaccgcagagaccatatggaggtgctgtctccatttaaggatggagttgttgctgactgggatattgttgacagcatatgggatcatgccttcagggactgcctattgattgatcctaaagagcatcctatgctccttgcagagccctcttctaactctcaacaacagagagaaaggacagtggagcatatgtttgagaagtacaaagcacctgcattatttttggcaaaaaatgctgttctgacttcttttgcatcagggcgtgctacgtctgtagttgttgatggtggtggaggctcaactacagttgcaccggtacatgatggttatgttcttcaaaaggctgtggcaacctctccaattggaggagaatttcttacagactgcttgatgaaaagtttggaaagcaagggtattatgataaaacctcggtattccttcaggagaaaggaaatacgccctggagagtttcagacagttgatcttgaatttcccaatactactgaaagctacaaactcttttcccagagggtgattgctagtgatatcaaggaatgtgtgtgccgtgctccagatactccatatgatgagagtgcgtattcaaacattccaatgacctcatatgagcttcctgatggccagacagttgaaattggagctgacagatttaagataccagatgttcttttcaatccatccctggttcagtcaattcctggcatggagagctttgcagaaattgctccttcagttcgtggcctgccccaaatggtgattgaaagcattaataagtgtgatgtagacattcgaagagagttgtttaatagtatactgcttgctggtggtacagcttcaatgcaacaactaaaggaacgccttgagaaagacttgttagaggaatcccctcaagctgccagagtaaaagtattggccagtgggaatgctactgaaagaaggtttagtgtttggatcgggggtagtatattggcatctcttggctccttccagcaaatgtggttctccaaatccgagtatgaagagcatggagcttcatatatccaaaggaagtgtccatgagttgctgtttattttactgccatttatcaggaagtagtactgtgaacgctgatttagtgcttgtctactaatgaatttttatttcctatttaatggccattcccattagatccccattctaactacattattggcctcgaggtgaatcacagcccacctttaactaatctgtattgatgtaaacttgtaaagtgtgcctagagtttgtaacaatgccccgttt

SEQ ID NO: 111 - protein, 446 aa, Glycine max
  VARIANT (1)...(446): Ceres Seq. ID no. 12446038
MYGGDEVSAIVIDLGSHTCKAGYAGEDAPKAVFPSVVGAIDQMDVDEADNGEKNPGSAPESNNNNVRNADSDKAKGKRKLYVGSQSLGYRRDHMEVLSPFKDGVVADWDIVDSIWDHAFRDCLLIDPKEHPMLLAEPSSNSQQQRERTVEHMFEKYKAPALFLAKNAVLTSFASGRATSVVVDGGGGSTTVAPVHDGYVLQKAVATSPIGGEFLTDCLMKSLESKGIMIKPRYSFRRKEIRPGEFQTVDLEFPNTTESYKLFSQRVIASDIKECVCRAPDTPYDESAYSNIPMTSYELPDGQTVEIGADRFKIPDVLFNPSLVQSIPGMESFAEIAPSVRGLPQMVIESINKCDVDIRRELFNSILLAGGTASMQQLKERLEKDLLEESPQAARVKVLASGNATERRFSVWIGGSILASLGSFQQMWFSKSEYEEHGASYIQRKCP

SEQ ID NO: 112 - protein, 404 aa, Glycine max
  VARIANT (1)...(404): Ceres Seq. ID no. 12446039
MDVDEADNGEKNPGSAPESNNNNVRNADSDKAKGKRKLYVGSQSLGYRRDHMEVLSPFKDGVVADWDIVDSIWDHAFRDCLLIDPKEHPMLLAEPSSNSQQQRERTVEHMFEKYKAPALFLAKNAVLTSFASGRATSVVVDGGGGSTTVAPVHDGYVLQKAVATSPIGGEFLTDCLMKSLESKGIMIKPRYSFRRKEIRPGEFQTVDLEFPNTTESYKLFSQRVIASDIKECVCRAPDTPYDESAYSNIPMTSYELPDGQTVEIGADRFKIPDVLFNPSLVQSIPGMESFAEIAPSVRGLPQMVIESINKCDVDIRRELFNSILLAGGTASMQQLKERLEKDLLEESPQAARVKVLASGNATERRFSVWIGGSILASLGSFQQMWFSKSEYEEHGASYIQRKCP

SEQ ID NO: 113 - protein, 353 aa, Glycine max
  VARIANT (1)...(353): Ceres Seq. ID no. 12446040
MEVLSPFKDGVVADWDIVDSIWDHAFRDCLLIDPKEHPMLLAEPSSNSQQQRERTVEHMFEKYKAPALFLAKNAVLTSFASGRATSVVVDGGGGSTTVAPVHDGYVLQKAVATSPIGGEFLTDCLMKSLESKGIMIKPRYSFRRKEIRPGEFQTVDLEFPNTTESYKLFSQRVIASDIKECVCRAPDTPYDESAYSNIPMTSYELPDGQTVEIGADRFKIPDVLFNPSLVQSIPGMESFAEIAPSVRGLPQMVIESINKCDVDIRRELFNSILLAGGTASMQQLKERLEKDLLEESPQAARVKVLASGNATERRFSVWIGGSILASLGSFQQMWFSKSEYEEHGASYIQRKCP

SEQ ID NO: 114 - DNA, 1334 bp, Glycine max
  misc_feature (1)...(1334): Ceres Seq. ID no. 12430830
atagtgagtgagagagagaaacaaaaagaaaagagagagctctttcattttcattcctttcaagggtttaacacaaacttcttattacttttgaaactatgatagggtttggagggaacagttgcagtgagctttctgagatggacatgacgaacatggaaactaataggaagtttctttctctgcctctcagtaacaacaacaactctggtgataatagaagggtacctgtcactagcaatagcatcgctcaggaacatcactacagccaccaccacaaccccaccgacacttgcagtgtgagggataaaatcatggcacatcctctttttcctcgtctcttatcctcttacctcaattgcctcaaggttggagcacctcctgaagtggtggctagcttagaggagtcatatgcaaaatatgagtccttcaatgcatcatcaggaaggataggaggtggttcaataggtgaagatccagctctggaccagttcatggaggcttactgtgagatgctcattaagtatgagcaagagcttacaaaacccttcaaagaagccatgcttttcttctcaagaattgagtgccagctcaaagccctagcagtttcatcagattttggtcaaagtgaaacatcttcaaagaatgaggttgatgttcatgaaaacaacctagattctcaagctgaagaccgggaactcaaagtccagcttttgcgcaagtatagtggatatctagggagcctcaagaaggaatttttgaagaagaaaaagaatggaaagttgccaaaggaagctcggcaacagctacttgattggtggaacaggcattataaatggccatacccttcggaatctcaaaagcaggcacttgcagaatccacaggcctagatatgaaacagatcaacaactggttcatcaatcagagaaaacgccattggaagccttctgaggatatgcaatttgccgtgatggatgcaactaactactacatggaaaatgttatgtgcaagccatttcccatggatagcatgcctatgcttctttaactcaatcctctaccactagaatatccaaaagctgagccgaaaaccctatctttttttaagttgcctaggtacccaagttgctataatgtcattgatgcatgttttactttaaaattgtagaaagcaggatgaaaattctaccttattatccctgaactgcaatctgtaactctaagtgagcgggaatctaactagctatatactctattatctacactgtttgtgcagatcactagagatgtcgtgtatgtgtagtttcctaatttaatgaatataatttgtttt

SEQ ID NO: 115 - protein, 316 aa, Glycine max
  VARIANT (1)...(316): Ceres Seq. ID no. 12430831
MIGFGGNSCSELSEMDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 116 - protein, 302 aa, Glycine max
  VARIANT (1)...(302): Ceres Seq. ID no. 12430832
MDMTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 117 - protein, 300 aa, Glycine max
  VARIANT (1)...(300): Ceres Seq. ID no. 12430833
MTNMETNRKFLSLPLSNNNNSGDNRRVPVTSNSIAQEHHYSHHHNPTDTCSVRDKIMAHPLFPRLLSSYLNCLKVGAPPEVVASLEESYAKYESFNASSGRIGGGSIGEDPALDQFMEAYCEMLIKYEQELTKPFKEAMLFFSRIECQLKALAVSSDFGQSETSSKNEVDVHENNLDSQAEDRELKVQLLRKYSGYLGSLKKEFLKKKKNGKLPKEARQQLLDWWNRHYKWPYPSESQKQALAESTGLDMKQINNWFINQRKRHWKPSEDMQFAVMDATNYYMENVMCKPFPMDSMPMLL

SEQ ID NO: 118 - DNA, 1426 bp, Glycine max
  misc_feature (1)...(1426): Ceres Seq. ID no. 12451750
  misc_feature (1)...(1426): n = A,T,C or G
aggcaaaaaggataagacagtgagtgtgtatgttgttgacaagcaaaagccatggagggtagtagttgctctaatgacacttcttatttgttggcttttggagaaaacagtggtgggctatgcccaatgacgatgatgcctttggtaacttcccatcatgcaacaaatcctagtaatcctagtaataatactaataataatgaaaacacaaactgtctcttcattcccaactgcagtaacagttctggaactccttctatcatgctccacaacaacaacaacactgatgatgataacaacaaaaccagcactaacactgggttagggtactatttcatggagagtgaccaccatcaccgcaacaacaacaacaatggaagctcctcctcctcttcctcttctgctgtcaaggccaagatcatggctcatcctcactatcaccgtctcttggcagcttacgtcaattgtcagaaggttggagccccaccggaagtggtggcaaggttagaagaagcatgtgcttctgcagcgacaatggctggtgatgcagcagcagcagctggatcaagctgcataggtgaagatccagctttggatcagttcatggaggcttactgtgagatgctcaccaagtatgagcaagaactctccaaacccttaaaggaagccatgctcttccttcaaaggattgagtgccagttcaaaaatcttacaatttcttccaccgactttgcttgcaacgagggtgctgagaggaatggatcatctgaagaggatgttgatctacacaacatgatagatccccaggcagaggacagggaattaaagggtcagcttttgcgcaagtacagcggatacctgggcagtctgaagcaagaattcatgaagaagaggaagaaaggaaagctacctaaagaagcaaggcaacaattacttgaatggtggagcagacattacaaatggccttacccatccgagtcacagaagctggcccttgcagagtcgacaggtctggatcagaagcaaatcaacaactggtttattaatcaaaggaaacggcactggaagccttcagaggacatgcagtttgtggtgatggatccaagccatccacactattacatggataatgttntgggcaatccatttcccatggatctctcccatccaatgctctagaaaagtatccatcctttgtgggctgataatagattcataagctcgttctgtcacttattaaaaccttaagcaattattaattaatatgctttctagtgctcatataagcattntaagaaatcctagattgctatatactatatttatagtacgcaggtgtatcctgctagcttaaanagacggtcctttgtgtggatcatctagttcaaggagttatgaataaataaaattccataaatttaaagcc

SEQ ID NO: 119 - protein, 375 aa, Glycine max
  VARIANT (1)...(375): Ceres Seq. ID no. 12451751
  VARIANT (1)...(375): Xaa = any amino acid
MEGSSCSNDTSYLLAFGENSGGLCPMTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVXGNPFPMDLSHPML

SEQ ID NO: 120 - protein, 350 aa, Glycine max
  VARIANT (1)...(350): Ceres Seq. ID no. 12451752
  VARIANT (1)...(350): Xaa = any amino acid
MTMMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVXGNPFPMDLSHPML

SEQ ID NO: 121 - protein, 348 aa, Glycine max
  VARIANT (1)...(348): Ceres Seq. ID no. 12451753
  VARIANT (1)...(348): Xaa = any amino acid
MMPLVTSHHATNPSNPSNNTNNNENTNCLFIPNCSNSSGTPSIMLHNNNNTDDDNNKTSTNTGLGYYFMESDHHHRNNNNNGSSSSSSSSAVKAKIMAHPHYHRLLAAYVNCQKVGAPPEVVARLEEACASAATMAGDAAAAAGSSCIGEDPALDQFMEAYCEMLTKYEQELSKPLKEAMLFLQRIECQFKNLTISSTDFACNEGAERNGSSEEDVDLHNMIDPQAEDRELKGQLLRKYSGYLGSLKQEFMKKRKKGKLPKEARQQLLEWWSRHYKWPYPSESQKLALAESTGLDQKQINNWFINQRKRHWKPSEDMQFVVMDPSHPHYYMDNVXGNPFPMDLSHPML

SEQ ID NO: 122 - DNA, 489 bp, Glycine max
  misc_feature (1)...(489): Ceres Seq. ID no. 13512808
agtagtggggtttgtccaatgatgatgatgcctttagtgacttctcatcatgttggtcatcatccattaaatcatcctattcttaataatcccaatcctaatgaacacacaaacactctcttccttcccatgccttgtactaataataatcaccacccgaaccgcaataaccacaactccaacgccactgagttagggtatttcatggagatccccaacaacaacaacgatggaagctcctcttccccttcttcagctgtcaaggccaagatcatggcccatcctcactatcaccgtctcttggcagcctacgtcaattgtcaaaaggttggggctccgcctgaagtggtgggaaggttagaagaagcatgtgcatctgctgcagtgataatggcaggtggaacagccagcataggcgaggatccagcgctggatcagttcatggaggcttactgtgagatgctgatcaagtacgagcaagagctctcc

SEQ ID NO: 123 - protein, 163 aa, Glycine max
  VARIANT (1)...(163): Ceres Seq. ID no. 13512809
SSGVCPMMMMPLVTSHHVGHHPLNHPILNNPNPNEHTNTLFLPMPCTNNNHHPNRNNHNSNATELGYFMEIPNNNNDGSSSSPSSAVKAKIMAHPHYHRLLAAYVNCQKVGAPPEVVGRLEEACASAAVIMAGGTASIGEDPALDQFMEAYCEMLIKYEQELS

SEQ ID NO: 124 - protein, 157 aa, Glycine max
  VARIANT (1)...(157): Ceres Seq. ID no. 13512810
MMMMPLVTSHHVGHHPLNHPILNNPNPNEHTNTLFLPMPCTNNNHHPNRNNHNSNATELGYFMEIPNNNNDGSSSSPSSAVKAKIMAHPHYHRLLAAYVNCQKVGAPPEVVGRLEEACASAAVIMAGGTASIGEDPALDQFMEAYCEMLIKYEQELS

SEQ ID NO: 125 - protein, 156 aa, Glycine max
  VARIANT (1)...(156): Ceres Seq. ID no. 13512811
MMMPLVTSHHVGHHPLNHPILNNPNPNEHTNTLFLPMPCTNNNHHPNRNNHNSNATELGYFMEIPNNNNDGSSSSPSSAVKAKIMAHPHYHRLLAAYVNCQKVGAPPEVVGRLEEACASAAVIMAGGTASIGEDPALDQFMEAYCEMLIKYEQELS

SEQ ID NO: 126 - DNA, 713 bp, Glycine max
  misc_feature (1)...(713): Ceres Seq. ID no. 12438736
atagctagccaagagctaccttaccaaactttccctttccgaggcttaggtcaccgactcaccggacagcaccgcaccgttgtcggatggattgcaagtacctaatctgatcgtcgcctattgaatttcgatccgaagcaattcatttcagataatttgttcgtccccttcgagtttcagaaaaactatatatattggtggacacgacacgacacgacacaacacaatgcaatgggaagctccaaagttcaaaggctttccgggatgcaaaagcaagtacttagcctatacagagggtttctgcgtgcagcacgttccaaatcggaggaagaacggtgcaagatagagtcaattatatcgcaagagtttcggcgtaatgcggaggatgtagatcgcaaaaattttctctacattgagtacttacttcgccgtggcaacaaacaacttgatcagcttaaaaaccctggtactacagggttatcttcgttgcaacttcattactctcacccttcaagtaagggttaaaatgcttgtcattaattattactacagttctgtttcgtgagatattcgcaatttattaagtccaataacaaaatcagttgcttactgtggacttacgtttgattttgtattcccaaggataatcacatgaatttcactttcggtttgtaattttgaaatcttaaaaaactggacccaattttagattt

SEQ ID NO: 127 - protein, 97 aa, Glycine max
  VARIANT (1)...(97): Ceres Seq. ID no. 12438737
MGSSKVQRLSGMQKQVLSLYRGFLRAARSKSEEERCKIESIISQEFRRNAEDVDRKNFLYIEYLLRRGNKQLDQLKNPGTTGLSSLQLHYSHPSSKG

SEQ ID NO: 128 - protein, 86 aa, Glycine max
  VARIANT (1)...(86): Ceres Seq. ID no. 12438738
MQKQVLSLYRGFLRAARSKSEEERCKIESIISQEFRRNAEDVDRKNFLYIEYLLRRGNKQLDQLKNPGTTGLSSLQLHYSHPSSKG

SEQ ID NO: 129 - DNA, 1441 bp, Glycine max
  misc_feature (1)...(1441): Ceres Seq. ID no. 12456213
  misc_feature (1)...(1441): n = A,T,C or G
atacatagatacatcttatttcattgggaaggaaaactctgagttaagttgcagacacacacgttaaccctgcgtgtagcctctgtgtctccacctgcattcaacacacacagcaacagcaacagcacactgatagtagtgtttgagagagagagagagaatgagattaataagaagcaaagcaacactgttgatgcacagaaggaagaaggtagactacacattcccaaggggaggactctgaaatctgaatctgaatctgattcccaccaccttttacaggctatagagccaagagcccaaaaatccctattgttctgactgactatccatttaggttctttggagttttctacaaataaaggactcagattttttagcttcatttccgggagtactctctggacaattatatgcagtgtgctctttttgagaaaacagtaaggtggggactagcaactaggaacaactgatccaagccaaagaggttggagcacctcctgaagtggtggctagcttagaggagtcatgtgccaaatgtgagtccttcaatgcatcatcaggaaggacaggtggttcaataggtgaagatccagctctggaccagttcatggaggcctactgtgagatgctcattaagtatgagcaagagctcactaaacccttcaaagaagccatgcttttcttctcaagaattgagtgtcaactcaaagccctagcagtttcatcagattttggtcaaagtgaaacatcttcgcagaatgaggttgatgttcatgaaaacaacctagattctcaagctgaagatcgtgaactcaaagtccagcttttgcgcaagtatagtggatatctagggagcctcaagaaggaatttttgaagaagaaaaagaatggaaagttgccaaaggaagctcggcaacagctacttgattggtggaacaggcattataaatggccatacccttcggaatctcaaaagcaggcacttgcagaatccacaggcctanatctgaaacaaatcaacaactggttcatcaatcagagaaaacgtcattggaagccttctgaggatatgcaatttgccgtgatggatgcaactaactactacatggaaaatgttatgtgcaagccatttccaatggatggcatgcctatgcttctttaactcaatcctctactagaatattcaaaagcttagccgagaaaaccctatctattttaagttgcctaggtcgccaggttgctatatataatgtgtcattgatgaatgttttactttaaattgtagaaagcaggatgaaaattctgttatccctgaactgcaatctatgtaagtgagcgtgaatctaactatatgctctattatctacactgtttgtggagatcactagagatgttgtgtatgtgttgtttcctaatttaatgaaaataatttgttttc

SEQ ID NO: 130 - protein, 184 aa, Glycine max
  VARIANT (1)...(184): Ceres Seq. ID no. 12456214
  VARIANT (1)...(184): Xaa = any amino acid
MEAYCEMLIKYEQELTKPFKEAMLFFSRIECQLKALAVSSDFGQSETSSQNEVDVHENNLDSQAEDRELKVQLLRKYSGYLGSLKKEFLKKKKNGKLPKEARQQLLDWWNRHYKWPYPSESQKQALAESTGLXLKQINNWFINQRKRHWKPSEDMQFAVMDATNYYMENVMCKPFPMDGMPMLL

SEQ ID NO: 131 - protein, 178 aa, Glycine max
  VARIANT (1)...(178): Ceres Seq. ID no. 12456215
  VARIANT (1)...(178): Xaa = any amino acid
MLIKYEQELTKPFKEAMLFFSRIECQLKALAVSSDFGQSETSSQNEVDVHENNLDSQAEDRELKVQLLRKYSGYLGSLKKEFLKKKKNGKLPKEARQQLLDWWNRHYKWPYPSESQKQALAESTGLXLKQINNWFINQRKRHWKPSEDMQFAVMDATNYYMENVMCKPFPMDGMPMLL

SEQ ID NO: 132 - protein, 162 aa, Glycine max
  VARIANT (1)...(162): Ceres Seq. ID no. 12456216
  VARIANT (1)...(162): Xaa = any amino acid
MLFFSRIECQLKALAVSSDFGQSETSSQNEVDVHENNLDSQAEDRELKVQLLRKYSGYLGSLKKEFLKKKKNGKLPKEARQQLLDWWNRHYKWPYPSESQKQALAESTGLXLKQINNWFINQRKRHWKPSEDMQFAVMDATNYYMENVMCKPFPMDGMPMLL

SEQ ID NO: 133 - DNA, 524 bp, Glycine max
  misc_feature (1)...(524): Ceres Seq. ID no. 3459752
atgcattactacttgtcttgatttctttctcgatccccaacatcactagctagctccttgtacacactctacaaccccacctagctacatcacttaattagttttaccaatttcaaattctcacctgtcactagctatatttcataactgatcattaccaactcatcactacatattattggctaggattcaccattagacttaagattagttgatttattacatatataagatgtctagcaggaggtcacggtcaaggcaaacaagtagttcaaggaatatcaccgatgatcagatcaatgatcttgtctctaagttgcaacagcttcttccagagattcgcgataggcgctctgacaaggtttcagcttccaaggtgttgcaagagacatgcaactatattagaagcttacacagggaagtgggtgacctaagcgagcgtttatctgagctcctggatacaactgacacggctcaagctgcaataattagaaatttactgatgcaatagatcggtgcagttg

SEQ ID NO: 134 - protein, 92 aa, Glycine max
  VARIANT (1)...(92): Ceres Seq. ID no. 3459753
MSSRRSRSRQTSSSRNITDDQINDLVSKLQQLLPEIRDRRSDKVSASKVLQETCNYIRSLHREVGDLSERLSELLDTTDTAQAAIIRNLLMQ

SEQ ID NO: 135 - protein, 48 aa, Glycine max
  VARIANT (1)...(48): Ceres Seq. ID no. 3459754
MIRSMILSLSCNSFFQRFAIGALTRFQLPRCCKRHATILEAYTGKWVT

SEQ ID NO: 136 - DNA, 766 bp, Glycine max
  misc_feature (1)...(766): Ceres Seq. ID no. 12438885
aagttttcaactcttgtcttctgttgcaaaaaccctaattgcggtgtaaaaccctagaaggaggaagaagaagaggaaggatgagacctttagacgagaaggagacgagcgcggtgttcgagaagctgttcaaattcgtcggaaacaacctgaagaacatcgtggagaacccctcacacgaaggtcctgattcgaaccctggccgctactgcttccgcctccacaagaacaagatcttctacgccagcgagtccctcgtcaaacgcgccaccaacgtcgcgcgccccaacctcgtctccctcggcacctgcatcggcaaatacacccacggcggcagcttccacctcaccgtccaggccctaaacttgctcgccgccaacgccaagcacaaggtctggctcaagccgcagtccgagatgtccttcttgtacggtaaccatgtcttgaagggcgcactgggcaaactctccgaaaacattgctgccggcgacggggttgtcgtgttctccatggccgacgtgccgttgggtttcggtgtcgccgcgaagtccacgctggattgtaggaagctggatccgaacgggattgttgttctgcaccaggccgatgtgggagagtacttgaggatggaggatgagctttgattgatgcattttcttgtaattggttttgatccatcttatgaaattacattatcttctatattatctgtacctcctttgaagttgcctatcttctatattatcttcgacttcgttctcgtttc

SEQ ID NO: 137 - protein, 187 aa, Glycine max
  VARIANT (1)...(187): Ceres Seq. ID no. 12438886
MRPLDEKETSAVFEKLFKFVGNNLKNIVENPSHEGPDSNPGRYCFRLHKNKIFYASESLVKRATNVARPNLVSLGTCIGKYTHGGSFHLTVQALNLLAANAKHKVWLKPQSEMSFLYGNHVLKGALGKLSENIAAGDGVVVFSMADVPLGFGVAAKSTLDCRKLDPNGIVVLHQADVGEYLRMEDEL

SEQ ID NO: 138 - DNA, 1799 bp, Glycine max
  misc_feature (1)...(1799): Ceres Seq. ID no. 13531805
aacccaaccaaactgaaccaaatcatcacacacacatactaagaagcaacaattcttctacaatggatctcctccttctggaaaagaccctcataggtctcttcctcgctgcggtggtcgccatcgccgtctccaccctccgcggccggaaattcaagctcccaccgggcccactccccgtcccaatcttcggcaactggctccaagtcggcgacgacctcaaccaccgcaacctcaccgatttggccaaaaaattcggtgacatcttcctcctccgcatggggcagcgcaacctcgtcgtggtttcttcccctgagctcgccaaagaggttctccacacgcagggcgtggagttcggctcccgcacccgcaacgtcgtcttcgacatcttcaccggaaagggccaagacatggtcttcaccgtctacggcgagcactggcgcaaaatgcgccgcatcatgaccgtccccttcttcaccaacaaggttgtgcaacaataccgccatggatgggaatcggaggctgccgccgtcgtcgaggacgtcaagaaaaaccccgacgccgccgtctccggcaccgtcatccgccgccgccttcagctcatgatgtacaacaacatgtaccgcataatgttcgaccggaggttcgagagcgaggaggatcccatcttccagaggctaagagccttgaacggagagaggagtcgcttggcgcagagctttgagtataactatggtgattttattcccatcttgagacccttcttgaagggttacttgaagatttgcaaggaggtgaaggagacgaggttgaagcttttcaaggattacttcgttgacgagaggaagaagcttggaagcaccaagagcaccaacaacaataatgaacttaaatgcgctattgaccacattttggatgcccagagaaaaggcgagatcaacgaagacaacgtcctctacattgttgaaaacatcaacgttgctgcaattgaaacaactctatggtcgattgagtggggcattgctgagcttgtgaaccacccagagatccagcaaaagttaagggatgagattgacagagttcttggagcagggcaccaagtgactgagccagacatccaaaagctcccatacctccaagcagtggtcaaggaaactcttcgtcttagaatggcaatccctctccttgtaccacacatgaacctccacgacgcaaagcttgggggctatgatatcccagctgagagcaagatcttggtgaatgcatggtggctggccaacaaccctgcacactggaagaagccagaggagttccggcctgagaggttcttcgaggaggagtcgcttgttgaagccaatggcaatgactttaggtaccttccctttggtgttggcagaagaagctgccctggaatcattcttgcattgccaattcttggcatcactttgggacgtttggtccaaaactttgagctcttgcctccccctggccagtcacagattgacactagtgagaaaggagggcaatttagcttgcacatactcaagcattccaccattgtggcaaagccaaggtcattttagactccaccacatgatcatgatcatatgatcaatccccttaattttttcttttttcttttcccttttctttactctgtattgtatcaatgcttgaaaatggggttgttccaaaaatgtcatatatatttggcctgctaatgggtattgtaaatctctgaacttgaagtgatgcacggttttgagatggttttctaataaacctacacttttgtctct

SEQ ID NO: 139 - protein, 526 aa, Glycine max
  VARIANT (1)...(526): Ceres Seq. ID no. 13531806
PNQTEPNHHTHILRSNNSSTMDLLLLEKTLIGLFLAAVVAIAVSTLRGRKFKLPPGPLPVPIFGNWLQVGDDLNHRNLTDLAKKFGDIFLLRMGQRNLVVVSSPELAKEVLHTQGVEFGSRTRNVVFDIFTGKGQDMVFTVYGEHWRKMRRIMTVPFFTNKVVQQYRHGWESEAAAVVEDVKKNPDAAVSGTVIRRRLQLMMYNNMYRIMFDRRFESEEDPIFQRLRALNGERSRLAQSFEYNYGDFIPILRPFLKGYLKICKEVKETRLKLFKDYFVDERKKLGSTKSTNNNNELKCAIDHILDAQRKGEINEDNVLYIVENINVAAIETTLWSIEWGIAELVNHPEIQQKLRDEIDRVLGAGHQVTEPDIQKLPYLQAVVKETLRLRMAIPLLVPHMNLHDAKLGGYDIPAESKILVNAWWLANNPAHWKKPEEFRPERFFEEESLVEANGNDFRYLPFGVGRRSCPGIILALPILGITLGRLVQNFELLPPPGQSQIDTSEKGGQFSLHILKHSTIVAKPRSF

SEQ ID NO: 140 - protein, 506 aa, Glycine max
  VARIANT (1)...(506): Ceres Seq. ID no. 13531807
MDLLLLEKTLIGLFLAAVVAIAVSTLRGRKFKLPPGPLPVPIFGNWLQVGDDLNHRNLTDLAKKFGDIFLLRMGQRNLVVVSSPELAKEVLHTQGVEFGSRTRNVVFDIFTGKGQDMVFTVYGEHWRKMRRIMTVPFFTNKVVQQYRHGWESEAAAVVEDVKKNPDAAVSGTVIRRRLQLMMYNNMYRIMFDRRFESEEDPIFQRLRALNGERSRLAQSFEYNYGDFIPILRPFLKGYLKICKEVKETRLKLFKDYFVDERKKLGSTKSTNNNNELKCAIDHILDAQRKGEINEDNVLYIVENINVAAIETTLWSIEWGIAELVNHPEIQQKLRDEIDRVLGAGHQVTEPDIQKLPYLQAVVKETLRLRMAIPLLVPHMNLHDAKLGGYDIPAESKILVNAWWLANNPAHWKKPEEFRPERFFEEESLVEANGNDFRYLPFGVGRRSCPGIILALPILGITLGRLVQNFELLPPPGQSQIDTSEKGGQFSLHILKHSTIVAKPRSF

SEQ ID NO: 141 - protein, 434 aa, Glycine max
  VARIANT (1)...(434): Ceres Seq. ID no. 13531808
MGQRNLVVVSSPELAKEVLHTQGVEFGSRTRNVVFDIFTGKGQDMVFTVYGEHWRKMRRIMTVPFFTNKVVQQYRHGWESEAAAVVEDVKKNPDAAVSGTVIRRRLQLMMYNNMYRIMFDRRFESEEDPIFQRLRALNGERSRLAQSFEYNYGDFIPILRPFLKGYLKICKEVKETRLKLFKDYFVDERKKLGSTKSTNNNNELKCAIDHILDAQRKGEINEDNVLYIVENINVAAIETTLWSIEWGIAELVNHPEIQQKLRDEIDRVLGAGHQVTEPDIQKLPYLQAVVKETLRLRMAIPLLVPHMNLHDAKLGGYDIPAESKILVNAWWLANNPAHWKKPEEFRPERFFEEESLVEANGNDFRYLPFGVGRRSCPGIILALPILGITLGRLVQNFELLPPPGQSQIDTSEKGGQFSLHILKHSTIVAKPRSF

SEQ ID NO: 142 - DNA, 1352 bp, Glycine max
  misc_feature (1)...(1352): Ceres Seq. ID no. 13581804
agttcacaccctagagggagtggatggattttgttgtttttcatataagggcaaagaaagatagaggagctagctagctagcgagcttcaaaactcaaaagcactgacacatacaaacaaaaagatctggctttcataaaattgagataaaagtgcaccgtctccgaatcatgtttataatattatcttcattagatcttgatctcatttttcatctgaaactaaaagaatatatatgtgcctttaccctatttagctatatgcacacacaacttgtcacatatcatattttgttcatcaagtttataattccttatctttgaacttacttacatccaagtaaggtctaagctagctggagttgattagatctagctagctagttttcgatctgcttaatttgttttccatgatctcttatatatagtaattttatttccctttaattaattaagaaagagttgaagaagaatgggaagggggaagatcgaaatcaaaaggattgagaacacaacaaatcggcaagtgaccttctgcaagagaagaaatgggcttctgaagaaagcttatgagctgtcagtgctgtgtgatgcagaagttgccctcatcgtcttctccagccgtggccgtctctatgagtattccaacaacaacataagatcaacaatagagaggtacaaaaaggcatgttctgatcactcaagcgcgagcactaccacagaaatcaatgctcagtattatcaacaagaatctgcaaagctgcgacagcaaatacagatgctgcaaaattctaacaggcacctgatgggtgatgccttaagcacactgactgtgaaggaacttaagcagttggagaatagacttgaaagaggaatcactagaatcagatctaagaaacatgagatgctactggctgaaattgaatacttccagaaaagggagattgaactggaaaatgaaaatctttgcctccgaactaagataactgacgtggagaggattcagcaagtaaacatggtttctgggccagaactgaatgccattcaggcattagcttcccgtaacttcttcaatccaaatatgttggaaggtggaactgtttaccctcactcagataagaagattcttcatcttgggtgatcaataatatatgatcttggctagcctatggcatgtctatccaattagccggtggctaaatgcattattattactactcttttggttgctcattaactagaccatgtgatctatatactacttatggattatggatacttatgtatgatgattgtatgatatcataacaatcagttagaaataataattaaaaaatagagttgtgtttgaag

SEQ ID NO: 143 - protein, 222 aa, Glycine max
  VARIANT (1)...(222): Ceres Seq. ID no. 13581805
MGRGKIEIKRIENTTNRQVTFCKRRNGLLKKAYELSVLCDAEVALIVFSSRGRLYEYSNNNIRSTIERYKKACSDHSSASTTTEINAQYYQQESAKLRQQIQMLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 144 - protein, 120 aa, Glycine max
  VARIANT (1)...(120): Ceres Seq. ID no. 13581806
MLQNSNRHLMGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 145 - protein, 111 aa, Glycine max
  VARIANT (1)...(111): Ceres Seq. ID no. 13581807
MGDALSTLTVKELKQLENRLERGITRIRSKKHEMLLAEIEYFQKREIELENENLCLRTKITDVERIQQVNMVSGPELNAIQALASRNFFNPNMLEGGTVYPHSDKKILHLG

SEQ ID NO: 146 - DNA, 689 bp, Glycine max
  misc_feature (1)...(689): Ceres Seq. ID no. 12480555
acatcatccattttcattcttcccctcctactcataatagtgagtttactctcagaatttggagaaagagttctcattcagtagtgtgaggagacgtaaaaagttacggaatcccaaaacaaaaaccgaatggcacctaaaaacttgggcaccaaattaacagcacttgttgtagatgacaatatactcaaccgaaagattcatcaaaatctgttggagagtgttggcgtgaaaaatcaaggagtggaaaatggccaagaagcagtggacattcattgccatgggcaaatatttgacctgattctcatggacatggatatgcccatcatgaatggcattgaggcaacaaaggaacttcgctcaatgggcattggtagcatgattgtcggtgtgtcatcacgctgtacggaagcagaaatacgaaaatttatggaagcggggctgaatgactaccatgagaaacccttgaacaatgctaagcttagttcaattcttgataagatcaaccctagttttactcgtaattagtggaaaaaatttaacgttacccgttccttgtttccaaattccatgtttagtttttcctttttttcttttgttgattctgtagttcttcttttactatggtgaagtctgtgactacgcacgtgagtatcaatgttagacaaaaataaagaaaagacttgagg

SEQ ID NO: 147 - protein, 132 aa, Glycine max
  VARIANT (1)...(132): Ceres Seq. ID no. 12480556
MAPKNLGTKLTALVVDDNILNRKIHQNLLESVGVKNQGVENGQEAVDIHCHGQIFDLILMDMDMPIMNGIEATKELRSMGIGSMIVGVSSRCTEAEIRKFMEAGLNDYHEKPLNNAKLSSILDKINPSFTRN

SEQ ID NO: 148 - protein, 73 aa, Glycine max
  VARIANT (1)...(73): Ceres Seq. ID no. 12480557
MDMDMPIMNGIEATKELRSMGIGSMIVGVSSRCTEAEIRKFMEAGLNDYHEKPLNNAKLSSILDKINPSFTRN

SEQ ID NO: 149 - protein, 71 aa, Glycine max
  VARIANT (1)...(71): Ceres Seq. ID no. 12480558
MDMPIMNGIEATKELRSMGIGSMIVGVSSRCTEAEIRKFMEAGLNDYHEKPLNNAKLSSILDKINPSFTRN

SEQ ID NO: 150 - DNA, 944 bp, Glycine max
  misc_feature (1)...(944): Ceres Seq. ID no. 12610129
taaaaccctagccgccgtccgtccccaaccttcaccgccgctccccctcaaccctccgccccccaaaccccgccgccgcctccgccatgcggccgctcgacgagaaggagaccacgatggtcttcgagaagctgttcaagttcaccggccccaacctgaagcacctcctggagcggccctccgtggagggccccgacccggagcccggccgctactgcctccgcctccacaagaaccgcgtcttctacgcctccgagtcgctcgtccgccgcgccaccgccgtgtcccgcacgcgcctcgccggggtcggcacgcccatcggcaagttcacccacggcggcgccttccacctcaccgtccacgcgctcgacctcctcgccgcccacgcgcgccgccgcatctggctcaagcccgacacggagcgctcgttcctcttcggcaactccgtgcccaagtccgcgctcgcgcgcatcacggagaacaccaagtccggcgatggcgtcgtcgtcatgtccatggccgacgtgccgctcgggttcggggtcgccgccaggggcgcgcaggactgcaggaaggccgacaccaacgccgtggtggtgctccaccagtccgacgccggcgagtacctccgcaaggaggaggagctcatgtgaggtgatgtgtgactgttctgaaagatgtgttccctcccttggttgtgatcaccgatcatctgtgcttgcaatcagtgtgcagttcgtcgaccattctgtattctgtagttttcatacagggcaaggaaaagcggatgtctgatctatctgagtgtcatagtagagtagttctcttttcaggcagttctgatggctataatttttgtcacgccgtagcttatcagtaagctactgcattgtatcgtgtgaactgtgaactgaagattccgtgaactaaatattatgataatg

SEQ ID NO: 151 - protein, 218 aa, Glycine max
  VARIANT (1)...(218): Ceres Seq. ID no. 12610130
KTLAAVRPQPSPPLPLNPPPPKPRRRLRHAAARREGDHDGLREAVQVHRPQPEAPPGAALRGGPRPGARPLLPPPPQEPRLLRLRVARPPRHRRVPHAPRRGRHAHRQVHPRRRLPPHRPRARPPRRPRAPPHLAQARHGALVPLRQLRAQVRARAHHGEHQVRRWRRRHVHGRRAARVRGRRQGRAGLQEGRHQRRGGAPPVRRRRVPPQGGGAHVR

SEQ ID NO: 152 - protein, 188 aa, Glycine max
  VARIANT (1)...(188): Ceres Seq. ID no. 12610131
MRPLDEKETTMVFEKLFKFTGPNLKHLLERPSVEGPDPEPGRYCLRLHKNRVFYASESLVRRATAVSRTRLAGVGTPIGKFTHGGAFHLTVHALDLLAAHARRRIWLKPDTERSFLFGNSVPKSALARITENTKSGDGVVVMSMADVPLGFGVAARGAQDCRKADTNAVVVLHQSDAGEYLRKEEELM

SEQ ID NO: 153 - protein, 178 aa, Glycine max
  VARIANT (1)...(178): Ceres Seq. ID no. 12610132
MVFEKLFKFTGPNLKHLLERPSVEGPDPEPGRYCLRLHKNRVFYASESLVRRATAVSRTRLAGVGTPIGKFTHGGAFHLTVHALDLLAAHARRRIWLKPDTERSFLFGNSVPKSALARITENTKSGDGVVVMSMADVPLGFGVAARGAQDCRKADTNAVVVLHQSDAGEYLRKEEELM

SEQ ID NO: 154 - DNA, 1002 bp, Glycine max
  misc_feature (1)...(1002): Ceres Seq. ID no. 13505209
cccgcgcgccgattccactaggttttccaactctcctgcacccgccgccgccacctcccctcccccaccacaccctcagccatggcggtcgtggagccggtgcccgggggcgacgtgaagctcttcaaccgctggaccttcgaggatgttcaggtgaccgacatctcgctgaacgactacctcgcggtgacgtcgatgaagcactacacgttcctgccgcactcggccggccgctactcggccaagcgcttccgcaaggcgcagtgccccatcatcgagcgcctcaccaactccctcatgatgcacgggcgcaacaacgggaagaagatcatggccgtccgcatcatcaagcacaccatggagatcatccacctcctcaccgacgccaaccccatccagatcatcgttgatgccatcatcaacagtggtccacgtgaggatgctacccgtattgggtctgctggtgttgtgaggagacaggctgtggatatctctcccctcaggagggtgaaccaggccatctaccttctgactactggtgccagggagagcgccttcaggaacgtcaagaccattgctgagtgccttgctgatgagctgatcaatgctgccaagggctcatccaacagctatgccatcaagaagaaggacgagattgagcgtgttgccaaggctaaccgttaagatggatgtgcatctgagggtctcgcttttggctggagattttgaagtgaatgtgttttacaagatatctagaactgttttagctatgcgttaagttttatggaatgaacatttcgatgtagtggcaagaacgtgcctgatgcttgtctttgtgaaacctattcctgttcagacatatttggatatgttgaatgtcgatgtgttctgtcataatatgtcttggtttgatctattcttgcgaatgcttattccactttgcaatagtgtatgcatgcttactattgcatacttaagctctgtcgtacttgtcattacaac

SEQ ID NO: 155 - protein, 200 aa, Glycine max
  VARIANT (1)...(200): Ceres Seq. ID no. 13505210
MAVVEPVPGGDVKLFNRWTFEDVQVTDISLNDYLAVTSMKHYTFLPHSAGRYSAKRFRKAQCPIIERLTNSLMMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 156 - protein, 162 aa, Glycine max
  VARIANT (1)...(162): Ceres Seq. ID no. 13505211
MKHYTFLPHSAGRYSAKRFRKAQCPIIERLTNSLMMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 157 - protein, 135 aa, Glycine max
  VARIANT (1)...(135): Ceres Seq. ID no. 13505212
RAPIPLGFPTLLHPPPPPPLPHHTLSHGGRGAGARGRREALQPLDLRGCSGDRHLAERLPRGDVDEALHVPAALGRPLLGQALPQGAVPHHRAPHQLPHDARAQQREEDHGRPHHQAHHGDHPPPHRRQPHPDHR

SEQ ID NO: 158 - DNA, 457 bp, Glycine max
  misc_feature (1)...(457): Ceres Seq. ID no. 12484682
aactcacccttttctgttgtaaaaccctaattgcggtgtaaaaccctagaaggaggaggaggaaggatgagacccttggacgagaaggagacgagcgcagtgttcgagaagctgttcaagttcgtcggaaacaacctgaagaacatcgtggagaacccctcgcacgaaggtcccgattcgaaccccgggcgctactgcttccggctccacaagaacaagatcttctacgccagcgagtccctcgtgaagcgcgccaccaacgtcgcccgccccaacctggtctccctcggcacctgcatcgggaaatacacccacggcggcagcttccacctcaccgtccaggccctcaacttgctcgccgccaacgccaagcacaaggtctggctcaagccccagtccgagatgtccttcttgtacggcaaccatgtcttgaagggcgctctcgggaaactctccg

SEQ ID NO: 159 - protein, 130 aa, Glycine max
  VARIANT (1)...(130): Ceres Seq. ID no. 12484683
MRPLDEKETSAVFEKLFKFVGNNLKNIVENPSHEGPDSNPGRYCFRLHKNKIFYASESLVKRATNVARPNLVSLGTCIGKYTHGGSFHLTVQALNLLAANAKHKVWLKPQSEMSFLYGNHVLKGALGKLS

SEQ ID NO: 160 - DNA, 562 bp, Glycine max
  misc_feature (1)...(562): Ceres Seq. ID no. 13645433
taagtcaccacactccgtttcccgccgcctccgccctctgccgccgcagccgcagccatgggcgcgtacaagttcgtgtcggagctatggaggaggaagcagtccgacgtgatgaggttcgtgcagcgcgtgcgttgctgggagtacaggcagcagcccgccatcgtccgcatcaccaggcccacccgccccgacagggcacgccgtctcggcttcaaggccaagcaggggtatgtggtctaccgtatccgtgtgagacgtggtggcaggaagcgcccagtgcccaagggtattgtttatggcaagcctaagcaccagggtattacccaactcaagttccagaggaacaagaggtctgttgctgaggaaagagctgggcgcaggcttggtggtcttcgtgtcctcaactcctactgggtgaatgaggactccacctacaagtactttgaggtcatccttgttgacgttgctcacagcgctgtccgcaacgatccaaggatcaactggctctgcaagcctgtgcacaagcaccgtgagctgcgtggtctcacctctgcgggaa

SEQ ID NO: 161 - protein, 168 aa, Glycine max
  VARIANT (1)...(168): Ceres Seq. ID no. 13645434
MGAYKFVSELWRRKQSDVMRFVQRVRCWEYRQQPAIVRITRPTRPDRARRLGFKAKQGYVVYRIRVRRGGRKRPVPKGIVYGKPKHQGITQLKFQRNKRSVAEERAGRRLGGLRVLNSYWVNEDSTYKYFEVILVDVAHSAVRNDPRINWLCKPVHKHRELRGLTSAG

SEQ ID NO: 162 - protein, 150 aa, Glycine max
  VARIANT (1)...(150): Ceres Seq. ID no. 13645435
MRFVQRVRCWEYRQQPAIVRITRPTRPDRARRLGFKAKQGYVVYRIRVRRGGRKRPVPKGIVYGKPKHQGITQLKFQRNKRSVAEERAGRRLGGLRVLNSYWVNEDSTYKYFEVILVDVAHSAVRNDPRINWLCKPVHKHRELRGLTSAG

SEQ ID NO: 163 - protein, 102 aa, Glycine max
  VARIANT (1)...(102): Ceres Seq. ID no. 13645436
SHHTPFPAASALCRRSRSHGRVQVRVGAMEEEAVRRDEVRAARALLGVQAAARHRPHHQAHPPRQGTPSRLQGQAGVCGLPYPCETWWQEAPSAQGYCLWQA

SEQ ID NO: 164 - DNA, 904 bp, Triticum aestivum
  misc_feature (1)...(904): Ceres Seq. ID no. 13585369
  misc_feature (1)...(904): n = A,T,C or G
cctaatcgaaaaaaaaccctaagtcaccacactccgtttcccgccgcctccgccctctgccgccgcagccgcagccatgggcgcgtacaagttcgtgtcggagctatggaggaggaagcagtccgacgtgatgaggttcgtgcagcgcgtgcgttgctgggagtacaggcagcagcccgccatcgtccgcatcaccaggcccacccgccccgacagggcacgccgtctcggcttcaaggccaaacagggttatgtgatctaccgtatccgtgtgagacgtggtggcaggaagcgcccagtgcccaagggtattgtttatggcaagcccaagcaccagggtattacccaactcaagttccagaggaacaagaggtctgttgctgaggaaagagctgggcgcaggcttggtggtcttcgtgtcctcaactcctactgggtgaatgaggactccacctacaagtactttgaggtcatccttgttgacgttgctcacagcgctgtccgcaacgatccaaggatcaactggctntgcaagcctgtgcacaagcaccgtgagctgcgtggtctcacctctgcgggaaagaaattccgtggtctgcgtggcaagggtcnccgccnccacaagaacaggccctcaaggagagccacctggaagaggaaccagaccgtctccctccgccgctaccgttaagcttatgtgctgttatgttctgtggaacctgccctatgcttaccttgatagtatctgtttgcnccgtcaaattttgctaccttcgttctgtggctgaacctccaggcatgtctgttgaactatttgctatgtgcctgtgttacctggaattcgaatgattgaagtagtcctcgatgtgtgctgattattgttttaatgctttgatgttttttt

SEQ ID NO: 165 - protein, 204 aa, Triticum aestivum
  VARIANT (1)...(204): Ceres Seq. ID no. 13585370
  VARIANT (1)...(204): Xaa = any amino acid
MGAYKFVSELWRRKQSDVMRFVQRVRCWEYRQQPAIVRITRPTRPDRARRLGFKAKQGYVIYRIRVRRGGRKRPVPKGIVYGKPKHQGITQLKFQRNKRSVAEERAGRRLGGLRVLNSYWVNEDSTYKYFEVILVDVAHSAVRNDPRINWXCKPVHKHRELRGLTSAGKKFRGLRGKGXRXHKNRPSRRATWKRNQTVSLRRYR

SEQ ID NO: 166 - protein, 186 aa, Triticum aestivum
  VARIANT (1)...(186): Ceres Seq. ID no. 13585371
  VARIANT (1)...(186): Xaa = any amino acid
MRFVQRVRCWEYRQQPAIVRITRPTRPDRARRLGFKAKQGYVIYRIRVRRGGRKRPVPKGIVYGKPKHQGITQLKFQRNKRSVAEERAGRRLGGLRVLNSYWVNEDSTYKYFEVILVDVAHSAVRNDPRINWXCKPVHKHRELRGLTSAGKKFRGLRGKGXRXHKNRPSRRATWKRNQTVSLRRYR

SEQ ID NO: 167 - protein, 127 aa, Triticum aestivum
  VARIANT (1)...(127): Ceres Seq. ID no. 13585372
PNRKKTLSHHTPFPAASALCRRSRSHGRVQVRVGAMEEEAVRRDEVRAARALLGVQAAARHRPHHQAHPPRQGTPSRLQGQTGLCDLPYPCETWWQEAPSAQGYCLWQAQAPGYYPTQVPEEQEVCC

SEQ ID NO: 168 - DNA, 701 bp, Triticum aestivum
  misc_feature (1)...(701): Ceres Seq. ID no. 12443604
  misc_feature (1)...(701): n = A,T,C or G
atgcacaacttgtcttccctctcttccaacaccacttcttcttagttcctctccgtccctgtctgccaccacttctgtctctcaaacttgtctcactccaaccataaaccctcactgtcttgggctctctctgccaagcatccaattcctaagtacatccgatcactcacatttgcagtgatgtcgagccgtaggtcaaggtcaaggcagtccggctcgtcgaggatcaccgacgagcaaatcagcgaccttgtctccaagttgcaggacctccttcccgaggcgcgtctccggggcaatgatagagtgccatcttcaagggtgctgcaggagacgtgcacctacatcaggagcttgcaccgggaggtggacgacctgagcgagaggctgtcggagctgctggcgacctcggacatgagcagcgcgcaagcggccatcatccgcagcttgctgatgtagagccggctcccatgcagtgcgcaggcgcctcgtcgctgtcttgctgagcgcacaagcctgaatttgagcgtttgtagcctagggagcgatctttaattagtaccggagttgcaggttacctacttaatccgcgtgtgtgcgctgtcgtcgtgtcatcatcgtnttaatcaggcccatcttttttgtgtgtgtacttaaatcaagtcgttaaatcaaaccccgcccgtggttggtgcaagttg

SEQ ID NO: 169 - protein, 92 aa, Triticum aestivum
  VARIANT (1)...(92): Ceres Seq. ID no. 12443605
MSSRRSRSRQSGSSRITDEQISDLVSKLQDLLPEARLRGNDRVPSSRVLQETCTYIRSLHREVDDLSERLSELLATSDMSSAQAAIIRSLLM

SEQ ID NO: 170 - protein, 59 aa, Triticum aestivum
  VARIANT (1)...(59): Ceres Seq. ID no. 12443606
CTTCLPSLPTPLLLSSSPSLSATTSVSQTCLTPTINPHCLGLSLPSIQFLSTSDHSHLQ

SEQ ID NO: 171 - DNA, 698 bp, Triticum aestivum
  misc_feature (1)...(698): Ceres Seq. ID no. 11421342
  misc_feature (1)...(698): n = A,T,C or G
tttctgctgtgcatgatggttatgttttgcaaaagtctgtggcaacttctccgataggcggtgaatttttgactgactgtatgatgaaaagcttggagagcaagggcgttgttatcaggccccggtattccttcaagaagaaggaagtgagccctggagattataaggttgtagaccttgattttccgaacaccacggatagttacaggttgtaccacatgagagctattgctagcgacatcaaggagacggtttgtagagttccagatactcccttcgatgaagtggcatatgcaaatgttcccacaacttcatacgagcttccagacgggcaaactattgaagttggtgcagagagattcaagattcctgacattttgttcaacccattcctttctcagactattcctgggatcgatggatttggagattccacttcgattcgtggacttccacgaatggccttgaaagtgtaaataggtgtgatgttgcattcgcaaggagctactcagcagcatcttgcttntggtggttatcatcaattctgcagtaaaggccgctanaaaagaagnctggggagccctcaaatctcggtaaggtttggcagnggaaatcacgaaggcattcatgctggttggaggacatcttnntcctggcgtccacaatgggttcaggaaaacaaaccgggttctttccag

SEQ ID NO: 172 - protein, 157 aa, Triticum aestivum
  VARIANT (1)...(157): Ceres Seq. ID no. 11421343
SAVHDGYVLQKSVATSPIGGEFLTDCMMKSLESKGVVIRPRYSFKKKEVSPGDYKVVDLDFPNTTDSYRLYHMRAIASDIKETVCRVPDTPFDEVAYANVPTTSYELPDGQTIEVGAERFKIPDILFNPFLSQTIPGIDGFGDSTSIRGLPRMALKV

SEQ ID NO: 173 - protein, 131 aa, Triticum aestivum
  VARIANT (1)...(131): Ceres Seq. ID no. 11421344
MMKSLESKGVVIRPRYSFKKKEVSPGDYKVVDLDFPNTTDSYRLYHMRAIASDIKETVCRVPDTPFDEVAYANVPTTSYELPDGQTIEVGAERFKIPDILFNPFLSQTIPGIDGFGDSTSIRGLPRMALKV

SEQ ID NO: 174 - protein, 130 aa, Triticum aestivum
  VARIANT (1)...(130): Ceres Seq. ID no. 11421345
MKSLESKGVVIRPRYSFKKKEVSPGDYKVVDLDFPNTTDSYRLYHMRAIASDIKETVCRVPDTPFDEVAYANVPTTSYELPDGQTIEVGAERFKIPDILFNPFLSQTIPGIDGFGDSTSIRGLPRMALKV

SEQ ID NO: 175 - DNA, 452 bp, Triticum aestivum
  misc_feature (1)...(452): Ceres Seq. ID no. 4390460
cacgcgcctcgccggggtcggcacgcccatcggcaagttcacccacggcggcgccttccacctcaccgtccacgcgctcgacctcctcgccgcccacgcgcgccgccgcatctggctcaagcccgacacggagcgctcgttcctcttcggcaactccgtgcccaagtccgcgctcgcgcgcatcaccgagaacaccaagtccggcgacggcgtcgtcgtcatgtccatggccgacgtgccgctcgggttcggggtcgccgccaggggcgcgcaggactgcaggaaggccgataccaacgccgtggtggtgctccaccagtcggatgctggcgagtacctccgcaaggaggaggagctcatgtgaggtgagggtcgaggcttggttgttattgtgtttactgattggaccttatgcgtgaatttagggctggagcagatattgccaatatctg

SEQ ID NO: 176 - protein, 138 aa, Triticum aestivum
  VARIANT (1)...(138): Ceres Seq. ID no. 4390461
RASPGSARPSASSPTAAPSTSPSTRSTSSPPTRAAASGSSPTRSARSSSATPCPSPRSRASPRTPSPATASSSCPWPTCRSGSGSPPGARRTAGRPIPTPWWCSTSRMLASTSARRRSSCEVRVEAWLLLCLLIGPYA

SEQ ID NO: 177 - protein, 122 aa, Triticum aestivum
  VARIANT (1)...(122): Ceres Seq. ID no. 4390462
HAPRRGRHAHRQVHPRRRLPPHRPRARPPRRPRAPPHLAQARHGALVPLRQLRAQVRARAHHREHQVRRRRRRHVHGRRAARVRGRRQGRAGLQEGRYQRRGGAPPVGCWRVPPQGGGAHVR

SEQ ID NO: 178 - protein, 120 aa, Triticum aestivum
  VARIANT (1)...(120): Ceres Seq. ID no. 4390463
TRLAGVGTPIGKFTHGGAFHLTVHALDLLAAHARRRIWLKPDTERSFLFGNSVPKSALARITENTKSGDGVVVMSMADVPLGFGVAARGAQDCRKADTNAVVVLHQSDAGEYLRKEEELM

SEQ ID NO: 179 - DNA, 1161 bp, Triticum aestivum
  misc_feature (1)...(1161): Ceres Seq. ID no. 12598265
agacacgagcggagcaccgagcaggcgcgcagcacatcatctgtcacaccggcggcggcggcggcatggggatgggcggtcgaggtgtggttggcgacaggtggtcgcagcgcgtcctctggatgtgcgccatcggcagcgccgtgagcctgtacttcgtggcggtggagaggcaggcgcagaaccgcgcgcgggcggtgtccgagggctttaagggcctggacggcgcagacggaggtggcagccgtggcggggaggacgtgtgactttggcggcgccgattccactaggttttccagctctcccgcacccgccgccgccacctccccactccccaccaccccctcagccatggcggtcgtcgagccggtgcccgggggcgacgtgaagctattcaaccgctggaccttcgaggatgttcaggtgagcgacatctcgctgaacgactacctcgcggtgacgtcgatgaagcactacaccttcctgccgcactcggccggccgctactcggccaagcgcttccgcaaggcgcagtgccccatcatcgagcgcctcaccaactccctcatgatgcacgggcgcaacaacggtaagaagatcatggccgtccgcatcatcaagcacaccatggagatcatccacctcctcaccgacgccaaccccatccagatcatcgttgacgccatcatcaacagtggtccacgtgaggatgctacccgtattgggtctgctggtgttgtgaggaggcaggctgtggatatctcccccctgaggagggtgaaccaggccatctaccttctgaccactggtgccagggagagcgccttcaggaatgtcaagaccattgctgagtgcctcgctgatgagctgatcaatgctgccaagggctcatccaacagctatgccatcaagaagaaggacgagattgagcgtgttgccaaggctaaccgttaagatggatgtgcatctgagggtctcatgcttttggctggagattttggactgaatgtgttttacaagatatctagaactgttttagctatgctttaagtttgtgatgaaagaacatttcgatgtagcggcaaggacttgcctgtctttatgaaaccaattcctgttcagacaaatttggagatgttgaatgtgtcgttgtgttctctc

SEQ ID NO: 180 - protein, 200 aa, Triticum aestivum
  VARIANT (1)...(200): Ceres Seq. ID no. 12598266
MAVVEPVPGGDVKLFNRWTFEDVQVSDISLNDYLAVTSMKHYTFLPHSAGRYSAKRFRKAQCPIIERLTNSLMMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 181 - protein, 162 aa, Triticum aestivum; identical to SEQ ID NO: 156
  VARIANT (1)...(162): Ceres Seq. ID no. 12598267

SEQ ID NO: 182 - protein, 128 aa, Triticum aestivum
  VARIANT (1)...(128): Ceres Seq. ID no. 12598268
MMHGRNNGKKIMAVRIIKHTMEIIHLLTDANPIQIIVDAIINSGPREDATRIGSAGVVRRQAVDISPLRRVNQAIYLLTTGARESAFRNVKTIAECLADELINAAKGSSNSYAIKKKDEIERVAKANR

SEQ ID NO: 183 - DNA, 464 bp, Triticum aestivum
  misc_feature (1)...(464): Ceres Seq. ID no. 13502974
aactcatctcaccctttctcttcttctgctaagttccgggctgagactaagaagaggtcgagatggggaggggaaggattgagatcaagaggatcgagaacaccactagccggcaggtgaccttctgcaagcgccggaacgggctcctcaaaaaggcctacgagctctccgtcctgtgcgacgccgaggtggcgctcatcgtcttctccagccgcggccgcctctacgagtactccaacaacagtgtcaaggctacaattgacaggtacaagaaggcacatgcttgtggctcaacctctggggtacctctcatagaagtcaatgctcagcaatactaccagcaagaagctgcaaagctgcgccaccagatccagatgctgcaaagcactaacaagcacttggttggtgattctgttgggaacctgtcactcaaggagctgaagcaactcgaaagccggcttgag

SEQ ID NO: 184 - protein, 134 aa, Triticum aestivum
  VARIANT (1)...(134): Ceres Seq. ID no. 13502975
MGRGRIEIKRIENTTSRQVTFCKRRNGLLKKAYELSVLCDAEVALIVFSSRGRLYEYSNNSVKATIDRYKKAHACGSTSGVPLIEVNAQQYYQQEAAKLRHQIQMLQSTNKHLVGDSVGNLSLKELKQLESRLE

SEQ ID NO: 185 - DNA, 492 bp, Triticum aestivum
  misc_feature (1)...(492): Ceres Seq. ID no. 11429655
ttgtagagttccagatactcccttcgatgaagtggcatatgcaaatgttcccacaacttcatacgagcttccagacgggcaaactattgaagttggtgcagagagattcaagattcctgacattttgttcaacccattcctttctcagactattcctgggatcgatggatttggagattccacttcgattcgtggacttccacgaatggtccttgaaagtgtaaataggtgtgatgttgacattcgcaaggagctactcagcagcatcttgctttctggtggctcatcatcaattctgcagttaaaggaccgtctagaaaaagaagtactggaggagtcccctcaaaatgctcgggtaaaggttttggcaagtggaaattcaacggagaggcgattcagtgtctggattggagggagcatccttgcatcccttgggtcgttccagcaaatgtggttctccaaggcagagtacgaagagcacggcgttcctat

SEQ ID NO: 186 - protein, 163 aa, Triticum aestivum
  VARIANT (1)...(163): Ceres Seq. ID no. 11429656
CRVPDTPFDEVAYANVPTTSYELPDGQTIEVGAERFKIPDILFNPFLSQTIPGIDGFGDSTSIRGLPRMVLESVNRCDVDIRKELLSSILLSGGSSSILQLKDRLEKEVLEESPQNARVKVLASGNSTERRFSVWIGGSILASLGSFQQMWFSKAEYEEHGVP

SEQ ID NO: 187 - protein, 95 aa, Triticum aestivum
  VARIANT (1)...(95): Ceres Seq. ID no. 11429657
MVLESVNRCDVDIRKELLSSILLSGGSSSILQLKDRLEKEVLEESPQNARVKVLASGNSTERRFSVWIGGSILASLGSFQQMWFSKAEYEEHGVP

SEQ ID NO: 188 - DNA, 679 bp, Zea mays
  misc_feature (1)...(679): Ceres Seq. ID no. 12401193
agtcgtcaggcgctctgcgctcaggttttcatcttcgggtgcccttcaccggcgaccagcacccaacaggctttgatgattgctgtacaaggatgatatggcctcccgcccaaagctgtctggtattcagaagcaggttttggcgctgtacaggggattccttcggacagcacgccttaaggcccctgaagaacgccgcaggatcgagtctgttgtctttgcagagttccgtgacaacgcaaggagtgttgaccgtaggaactttgtacacatagagtacttgttgaggagagggaagaagcagcttgagcagctcaagaatcctgatattactggactcgctacccttgtagtaaagaaatgagcaacagttgtcgaaatttacaggtccattcattgccagaacaaagtatcatcatgataccggtgtttctaatgtgaagatttggaacctgccactgatggtgtccaaataaaataaatatgaccacagattacagatttgatatccagggactttctaatcagcctattagaatctgaagataaatcttatagcacctgtccggtgacccatagtaatattattttactcttgctgtaagcagaggttaacactaaaaaaagtattgtgattggtctgaactttttgtgcggtataaagcatgtgattcagccc

SEQ ID NO: 189 - protein, 90 aa, Zea mays
  VARIANT (1)...(90): Ceres Seq. ID no. 12401194
SSGALRSGFHLRVPFTGDQHPTGFDDCCTRMIWPPAQSCLVFRSRFWRCTGDSFGQHALRPLKNAAGSSLLSLQSSVTTQGVLTVGTLYT

SEQ ID NO: 190 - protein, 88 aa, Zea mays
  VARIANT (1)...(88): Ceres Seq. ID no. 12401195
MASRPKLSGIQKQVLALYRGFLRTARLKAPEERRRIESVVFAEFRDNARSVDRRNFVHIEYLLRRGKKQLEQLKNPDITGLATLVVKK

SEQ ID NO: 191 - protein, 60 aa, Zea mays
  VARIANT (1)...(60): Ceres Seq. ID no. 12401196
MIWPPAQSCLVFRSRFWRCTGDSFGQHALRPLKNAAGSSLLSLQSSVTTQGVLTVGTLYT

SEQ ID NO: 192 - DNA, 467 bp, Zea mays
  misc_feature (1)...(467): Ceres Seq. ID no. 1423353
  misc_feature (1)...(467): n = A,T,C or G
atagcttggctcgcacggtgtcgctggctcccctccccttccctccccactgttacatccagcgagctgttcacggccgtgcsaagctcagtgaggcagcgtttgckagtccgggacgaggggagcggcgggcgacatggggaggggccgcagcgagataaagcggatcgagaaccccacgcagcggcagtccaccttctacaagcgcagggacggcctcttcaagaaggctagggagctctccgttctgtgcgacgtggacctgctgctgctcctcttctccacctccggcaagctctaccaggccacgacgcacaccaaggtctggaccgacatccgccaggagcggcgcgcggnastggagaaggcggacagatgtgcgagctgatggagaaggagctgcgggtcatnacgggtggacgacgggggancagtacacggtgccgtcgctggagctgctggagcac

SEQ ID NO: 193 - protein, 77 aa, Zea mays
  VARIANT (1)...(77): Ceres Seq. ID no. 1423354
  VARIANT (1)...(77): Xaa = any amino acid
IAWLARCRWLPSPSLPTVTSSELFTAVXSSVRQRLXVRDEGSGGRHGEGPQRDKADREPHAAAVHLLQAQGRPLQEG

SEQ ID NO: 194 - protein, 52 aa, Zea mays
  VARIANT (1)...(52): Ceres Seq. ID no. 1423355
  VARIANT (1)...(52): Xaa = any amino acid
SLARTVSLAPLPFPPHCYIQRAVHGRXKLSEAAFXSPGRGERRATWGGAAAR

SEQ ID NO: 195 - protein, 83 aa, Zea mays
  VARIANT (1)...(83): Ceres Seq. ID no. 1423356
  VARIANT (1)...(83): Xaa = any amino acid
MGRGRSEIKRIENPTQRQSTFYKRRDGLFKKARELSVLCDVDLLLLLFSTSGKLYQATTHTKVWTDIRQERRAXXEKADRCAS

SEQ ID NO: 196 - DNA, 886 bp, Zea mays
  misc_feature (1)...(886): Ceres Seq. ID no. 12346229
aaacctcctcactcctcagactcctctccgcacacaccctccctacctcgccgtcgccgtcgcatctgccatgggggcgtacaagtacgtctcggagttatggagaaggaagcaatccgacgtgatgcggttcgttcaacgcgtgcgctgttgggagtacaggcagcagccggccatcgtccgcctcacaaggcccacccgccccgacaaggcccgccgcctcggcttcaaggccaagcaggggtatgttgtttaccgcgtccgtgtgaggcgtggtggcaggaagaggcctgtgccgaagggtattgtctatggcaagcccaagcaccagggtatcacccagctcaagttccagaggaacaagagatctgttgctgaggaacgggctggacgaaagcttggtggactcagggttctcaactcctactgggtgaatgaggatagcacctacaagtactttgagatcatcctggttgatgtggcccacactgccatccgcaacgacccaagaatcaactggctatgcaatcctgtgcacaagcatcgtgagctccgtggtctcacctctgcaggcaagaagttccgtggcctgcgtggcaagggccacactcaccacaagaacaggccgtcgaggagggccacctggaagcgcaaccagaccctgtccctccgccgctaccgttgagcacacacatcttgatgctctgctaccgtggaacccgccccatgcaggctatgatagtatttggtatttttgttgcattgttaaattttgctacccgtgttccttccgagccccttgaactgtgttgtcagtgtaccgtggagcaagtgacgcgaactatatttgtggttctcagtcaatgaaaatgattgtttgtagttt

SEQ ID NO: 197 - protein, 227 aa, Zea mays
  VARIANT (1)...(227): Ceres Seq. ID no. 12346230
NLLTPQTPLRTHPPYLAVAVASAMGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 198 - protein, 204 aa, Zea mays
  VARIANT (1)...(204): Ceres Seq. ID no. 12346231
MGAYKYVSELWRRKQSDVMRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 199 - protein, 186 aa, Zea mays
  VARIANT (1)...(186): Ceres Seq. ID no. 12346232
MRFVQRVRCWEYRQQPAIVRLTRPTRPDKARRLGFKAKQGYVVYRVRVRRGGRKRPVPKGIVYGKPKHQGITQLKFQRNKRSVAEERAGRKLGGLRVLNSYWVNEDSTYKYFEIILVDVAHTAIRNDPRINWLCNPVHKHRELRGLTSAGKKFRGLRGKGHTHHKNRPSRRATWKRNQTLSLRRYR

SEQ ID NO: 200 - DNA, 1829 bp, Zea mays
  misc_feature (1)...(1829): Ceres Seq. ID no. 12349430
agaccccctctcgcttcgcccctcctcatcctctctcctctctcccccgccccgttcgtctccggcgagctagggtttgcccccccgccttgccaccccacggttcccgccatccttggatctccagccatgtacggcggagacgaggtttcggcaatcgtcatagatgtgggctcttacagctgcaaggcgggctacgcaggcgacgacacccccaaggccgtcttcccatcggttgttggttcaattgaacaaactgaagacacagatgaccccaagccagagaaggaagctgactctgcatcagattctaagaacggtgccaagcccatggatgtggacaaagccaagacaaaacgcagactttatgtaggccaagagttagagttcaggagggatcacatggaggtgatttcatctatgaaagatggaacggtaactgactgggatattgttgataatatatggaatcatgctttcagacggaggttgttgatcaatcctgaagagcatcctatgctcattgctgaaccatctacaaacactgcacagcaaagagagaaagcagcggaacttatttttgagaactacaaagtgccagcgctgtttctagccaaaaatgcagtgctcacatcttttgcgtctggacgagctacatctttggtggttgacagtggtggtgggtctactgtggtttctgctgtacacgatggttttgttttacagaagtctgtgtcgacttctccagttggcggtgaatttttaactgactgtatgatgaaaagcttggagagcaagggcatcgtcattaggcccagatattcatttaagaagaaggaaatcagtcctggagaatataagattgtagatcttgatcttccaaacacaactgagagttacaggttgtactgcatgagagctattgctagtgacgtcaaggagtctgtttgcagagttccagacactgcttttgatgaagtggcatatgcaaatgttcctacaacttcatatgagcttcctgatggacaaactattgaagttggtgctgatagattcaaggttcctgatattctatttaatccatctctatcccagactattcctgggattgatggatttgcagattcaataccagtccgtggccttcaacgaatggtcattgatagcgtaaataagtgcgacgttgacatacgaaaagagctattcagtaacatcttgctctctggtgggtcatcatcaattctgcagttaaaggagcgcctggagaaagaagtattggaggagtctcctcaagctgctcgtgtcaaggttatggcaagcggaaactcagtagagagacgtttcagtgtttggattggagggagcattctagcatctcttgggtcgttccagcagatgtggttctccaaagcagagtatgaagagcatggggtttcctatattcagagaaagtgcccttgaagcagggtaaggaatatgtacaaccaatattatgctttacgagccttattgttgccaaagggttccttgtgtacaacagcctggtgccttgccatgttggccaatgaatactcgagactcttttcaagtgacgtttgttgtcttcatggctagttaattttaggtgatgtaaggtgaacgtaagaactaggtcaactaaaatatttatcattgacagtatgctgaatctgtctccccttctgtagaatgagacgggaccccatcttgttctgtaccggggctaattctttgccagcacacaaagagccaagacgattgttgtaactcgggttatttaaatcccagctgcagagcaaatacacaacttt

SEQ ID NO: 201 - protein, 486 aa, Zea mays
  VARIANT (1)...(486): Ceres Seq. ID no. 12349431
RPPLASPLLILSPLSPAPFVSGELGFAPPPCHPTVPAILGSPAMYGGDEVSAIVIDVGSYSCKAGYAGDDTPKAVFPSVVGSIEQTEDTDDPKPEKEADSASDSKNGAKPMDVDKAKTKRRLYVGQELEFRRDHMEVISSMKDGTVTDWDIVDNIWNHAFRRRLLINPEEHPMLIAEPSTNTAQQREKAAELIFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 202 - protein, 443 aa, Zea mays
  VARIANT (1)...(443): Ceres Seq. ID no. 12349432
MYGGDEVSAIVIDVGSYSCKAGYAGDDTPKAVFPSVVGSIEQTEDTDDPKPEKEADSASDSKNGAKPMDVDKAKTKRRLYVGQELEFRRDHMEVISSMKDGTVTDWDIVDNIWNHAFRRRLLINPEEHPMLIAEPSTNTAQQREKAAELIFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 203 - protein, 376 aa, Zea mays
  VARIANT (1)...(376): Ceres Seq. ID no. 12349433
MDVDKAKTKRRLYVGQELEFRRDHMEVISSMKDGTVTDWDIVDNIWNHAFRRRLLINPEEHPMLIAEPSTNTAQQREKAAELIFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 204 - DNA, 1690 bp, Zea mays
  misc_feature (1)...(1690): Ceres Seq. ID no. 12450440
aaagccaagcggtcagcgtcagaatagcatggcggtgtccgcggccaggatggccgtcgccacggccgtctccttagccgtgcactggctcctccggtccttcctccaggcgcagcaccccgcgctgggcctgctcttcccgaccgccgtcttcatcggcattgccgcgtctggcaacgtcgcaggcgctgccaacgacgcgccgccggggccgccggccgtgccggtgttcggcaactggctgcaggtgggcaacgacctgaaccaccgcttcctggcgcgcctgtccgcgcggtacgggcccgtcttccgcctccgcctcggcgtgcgcaacctggtggtcgtctccgacccgcgcctcgccacggaggtgctgcacacgcagggggtggagttcggctcccgcccccgcaacgtcgtattcgacatcttcaccgccaacggcgccgacatggtgttcaccgagtacggcgaccactggcgccgcatgcgccgcgtcatgacgctgcccttcttcaccgcgcgcgtcgtgcagcagtacaggggcatgtgggaggccgagatggacgccgccgtctccgacgtcgcctccgcggcccagcgcgccgccggcctcgtcgtgcggcgcaggctgcagctcatgctctacaacatcatgtacgggatgatgttcgacgcgcgcttcggctccgtcgacgaccccatgttcgtggaggccaccaggttcaactccgagcgcagccgcctcgcgcagagcttcgactacaactacggcgacttcatccccgtcctgcgcccattcctgcgcggctacctcgccagatgcaaggacctgcaggccaggcggctcgccttcttcaacagcaactacgtcgagaagaggaggaaggtcatggacgcgccgggggacaagggcaagctcaggtgcgccatcgaccacgtcctccaggcggagaagagcggcgagatcaccccggagaacgtcatctacatcgtcgagaacatcaacgtcgccgccatcgagaccacgctctggtccatcgagtgggcgctcgcggaggtcgtcaaccacccggcggtgcagcgcaaggtccgcgacgagatcaaggccgtcgtcgccgaccacgagcccatcacggagtccaccatccaccgcctcccctacctgcaggccgtcatcaaggagacgctgcgcctccactccccgatcccgctcctcgtcccgcacatgaacctcgaggaggccaagctcggcggctacaccatccccaagggctccaaggtggtggtcaacgcgtggtggctggccaacaatccggagctgtgggacaagcccgaggagtttcggccggagcggttcctaggcgaggagaagagcgtggacgccaccgtcggcgggaaggtggacttccgcttcctgccgttcggcgtgggccgccgcagctgccccgggatcatcctcgcgctgcccatcctcgcgctcatcgtcggcaagctcgtgcgcagcttcgagatggtaccaccgcccggcgtggagaagctcgacgtcagcgagaaaggaggacagttcagcctgcacattgccaaccactccgtcatcgccttccaccccgtctctgcataatagattgattgatagccaaccacgaatgctgcgcgtcgttttctgcatatcaatgttatcctaccc

SEQ ID NO: 205 - protein, 540 aa, Zea mays
  VARIANT (1)...(540): Ceres Seq. ID no. 12450441
KPSGQRQNSMAVSAARMAVATAVSLAVHWLLRSFLQAQHPALGLLFPTAVFIGIAASGNVAGAANDAPPGPPAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRGMWEAEMDAAVSDVASAAQRAAGLVVRRRLQLMLYNIMYGMMFDARFGSVDDPMFVEATRFNSERSRLAQSFDYNYGDFIPVLRPFLRGYLARCKDLQARRLAFFNSNYVEKRRKVMDAPGDKGKLRCAIDHVLQAEKSGEITPENVIYIVENINVAAIETTLWSIEWALAEVVNHPAVQRKVRDEIKAVVADHEPITESTIHRLPYLQAVIKETLRLHSPIPLLVPHMNLEEAKLGGYTIPKGSKVVVNAWWLANNPELWDKPEEFRPERFLGEEKSVDATVGGKVDFRFLPFGVGRRSCPGIILALPILALIVGKLVRSFEMVPPPGVEKLDVSEKGGQFSLHIANHSVIAFHPVSA

SEQ ID NO: 206 - protein, 531 aa, Zea mays
  VARIANT (1)...(531): Ceres Seq. ID no. 12450442
MAVSAARMAVATAVSLAVHWLLRSFLQAQHPALGLLFPTAVFIGIAASGNVAGAANDAPPGPPAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRGMWEAEMDAAVSDVASAAQRAAGLVVRRRLQLMLYNIMYGMMFDARFGSVDDPMFVEATRFNSERSRLAQSFDYNYGDFIPVLRPFLRGYLARCKDLQARRLAFFNSNYVEKRRKVMDAPGDKGKLRCAIDHVLQAEKSGEITPENVIYIVENINVAAIETTLWSIEWALAEVVNHPAVQRKVRDEIKAVVADHEPITESTIHRLPYLQAVIKETLRLHSPIPLLVPHMNLEEAKLGGYTIPKGSKVVVNAWWLANNPELWDKPEEFRPERFLGEEKSVDATVGGKVDFRFLPFGVGRRSCPGIILALPILALIVGKLVRSFEMVPPPGVEKLDVSEKGGQFSLHIANHSVIAFHPVSA

SEQ ID NO: 207 - protein, 524 aa, Zea mays
  VARIANT (1)...(524): Ceres Seq. ID no. 12450443
MAVATAVSLAVHWLLRSFLQAQHPALGLLFPTAVFIGIAASGNVAGAANDAPPGPPAVPVFGNWLQVGNDLNHRFLARLSARYGPVFRLRLGVRNLVVVSDPRLATEVLHTQGVEFGSRPRNVVFDIFTANGADMVFTEYGDHWRRMRRVMTLPFFTARVVQQYRGMWEAEMDAAVSDVASAAQRAAGLVVRRRLQLMLYNIMYGMMFDARFGSVDDPMFVEATRFNSERSRLAQSFDYNYGDFIPVLRPFLRGYLARCKDLQARRLAFFNSNYVEKRRKVMDAPGDKGKLRCAIDHVLQAEKSGEITPENVIYIVENINVAAIETTLWSIEWALAEVVNHPAVQRKVRDEIKAVVADHEPITESTIHRLPYLQAVIKETLRLHSPIPLLVPHMNLEEAKLGGYTIPKGSKVVVNAWWLANNPELWDKPEEFRPERFLGEEKSVDATVGGKVDFRFLPFGVGRRSCPGIILALPILALIVGKLVRSFEMVPPPGVEKLDVSEKGGQFSLHIANHSVIAFHPVSA

SEQ ID NO: 208 - DNA, 457 bp, Zea mays
  misc_feature (1)...(457): Ceres Seq. ID no. 1681038
atatagttcctgctaactgatcgagatcgctctcgtttgtactttctccctttgaggaaatagttccccttttatgtgcttcaagttcttctggtatcgtcgccagcatgggtagaggaaggattgagatcaagaggatcgagaacaacacgagccggcaggtcaccttctgcaagcgccgcaatgggctcctcaagaaggcgtacgagctctccgtcctctgcgacgctgaggtggccctcatcgtcttctctagccgtggtcgcctctacgagtatgccaacaacagtgtcaaggctactgttgagaggtacaagaaggcacacaccgttggctcttcctctgggcccccgctcctagagcacaatgcccagcaattctaccagcaagaatcagcaaaactgcgcaaccagatccagatgctgcaaaacactaacaggcacttggttggtgactc

SEQ ID NO: 209 - protein, 116 aa, Zea mays
  VARIANT (1)...(116): Ceres Seq. ID no. 1681039
MGRGRIEIKRIENNTSRQVTFCKRRNGLLKKAYELSVLCDAEVALIVFSSRGRLYEYANNSVKATVERYKKAHTVGSSSGPPLLEHNAQQFYQQESAKLRNQIQMLQNTNRHLVGD

SEQ ID NO: 210 - protein, 58 aa, Zea mays
  VARIANT (1)...(58): Ceres Seq. ID no. 1681040
MGSSRRRTSSPSSATLRWPSSSSLAVVASTSMPTTVSRLLLRGTRRHTPLALPLGPRS

SEQ ID NO: 211 - DNA, 811 bp, Zea mays
  misc_feature (1)...(811): Ceres Seq. ID no. 12556477
tcttaaagcttctcgttttctctgccgtctctctcattcgcgcgacgcaaacgatcttcagccatggccaccgccgcagatgttgacgctgagattcagcaggcgctcactaacgaagtcaagctcttcaaccgctggacctatgacgacgttacggtcacagacatcagtcttgttgactacattggagttcaggcagctaaacatgctacctttgttccccacaccgctggaagatactctgtgaagagattcaggaaggctcagtgccccattgttgagaggctcaccaactctctcatgatgcacgggaggaacaacggtaagaaattgatggctgtcaggatcgtcaagcacgccatggagattatccacctcttgtctgacttgaacccaattcaggtcatcattgacgccattgtcaacagtggtccacgtgaagatgctaccagaattggatctgctggtgttgttaggagacaagctgttgatatctctcctctaagacgtgttaaccaggctatcttcttgattaccactggtgctcgtgaagctgctttcagaaacatcaagactatagctgagtgccttgctgatgaattgatcaacgcacccaagggctctttcaaacagctatgccttcaagaaagaaggatgagattgaaagagttgccaaggctaatcgttaaggattttccttttgccctgtgccgttacaatctcgtatcaatgagtttaatgttttatcttcatttagattgaaatatgtatctcagatgtttggtcttttgttttatgaagtttatttcgt

SEQ ID NO: 212 - protein, 232 aa, Zea mays
  VARIANT (1)...(232): Ceres Seq. ID no. 12556478
MATAADVDAEIQQALTNEVKLFNRWTYDDVTVTDISLVDYIGVQAAKHATFVPHTAGRYSVKRFRKAQCPIVERLTNSLMMHGRNNGKKLMAVRIVKHAMEIIHLLSDLNPIQVIIDAIVNSGPREDATRIGSAGVVRRQAVDISPLRRVNQAIFLITTGAREAAFRNIKTIAECLADELINAPKGSFKQLCLQERRMRLKELPRLIVKDFPFALCRYNLVSMSLMFYLHLD

SEQ ID NO: 213 - protein, 153 aa, Zea mays
  VARIANT (1)...(153): Ceres Seq. ID no. 12556479
MMHGRNNGKKLMAVRIVKHAMEIIHLLSDLNPIQVIIDAIVNSGPREDATRIGSAGVVRRQAVDISPLRRVNQAIFLITTGAREAAFRNIKTIAECLADELINAPKGSFKQLCLQERRMRLKELPRLIVKDFPFALCRYNLVSMSLMFYLHLD

SEQ ID NO: 214 - protein, 152 aa, Zea mays
  VARIANT (1)...(152): Ceres Seq. ID no. 12556480
MHGRNNGKKLMAVRIVKHAMEIIHLLSDLNPIQVIIDAIVNSGPREDATRIGSAGVVRRQAVDISPLRRVNQAIFLITTGAREAAFRNIKTIAECLADELINAPKGSFKQLCLQERRMRLKELPRLIVKDFPFALCRYNLVSMSLMFYLHLD

SEQ ID NO: 215 - DNA, 435 bp, Zea mays
  misc_feature (1)...(435): Ceres Seq. ID no. 13571374
acaactcagttattctacagctttaattttgcagagcgaccaccagtccaggtccagcgcgggacgcatcacatacacgcggtaccttcgttcgttctcaagcttatagcgcccgatcgaccctgcgcggagctagttcgttcgttccggcaggcggcggcagcgaagcagtgcgacgacgacgacgaggtacgtagagagcgagaggatagatgtcgagccgaaggtcgtcgtcgcacggcaacatctccgaggacgagatgaacgagctcgtctccaagctccaggccctgctccccagctcccgccgccgccgcggctccggccaggcgtcgacggcgaagctgctgaaggagacctgcagctacatcaagagcctccagcgggaggtggacgacctcagcgaccggctgtcggacctcttgtccaccatgg

SEQ ID NO: 216 - protein, 87 aa, Zea mays
  VARIANT (1)...(87): Ceres Seq. ID no. 13571375
TTQLFYSFNFAERPPVQVQRGTHHIHAVPSFVLKLIAPDRPCAELVRSFRQAAAAKQCDDDDEVRREREDRCRAEGRRRTATSPRTR

SEQ ID NO: 217 - protein, 74 aa, Zea mays
  VARIANT (1)...(74): Ceres Seq. ID no. 13571376
MSSRRSSSHGNISEDEMNELVSKLQALLPSSRRRRGSGQASTAKLLKETCSYIKSLQREVDDLSDRLSDLLSTM

SEQ ID NO: 218 - protein, 58 aa, Zea mays
  VARIANT (1)...(58): Ceres Seq. ID no. 13571377
MNELVSKLQALLPSSRRRRGSGQASTAKLLKETCSYIKSLQREVDDLSDRLSDLLSTM

SEQ ID NO: 219 - DNA, 453 bp, Zea mays
  misc_feature (1)...(453): Ceres Seq. ID no. 4616604
atcagtagtagtggcattttgcccctgctgtgccatctctctctcgctctcgctcctctcctctttttctctcctgctcagccttgcttcccgtcccatcctttctttcccttgggcgcattcagcagcttcagcctggccggccggcctgctattaaaccactttgcttgcaagtccaagaaactgctagagaggaacaagctgagatctccagcatggggaggggaaggattgagatcaagaggatcgagaacaacacgagccggcaggtcaccttctgcaagcgccgcaatgggctcctcaagaaggcgtacgagctctccgtcctctgcgacgccgaggtggcgctcgtcgtcttctccagccgcggacgcctctacgagtacgccaacaacagtgtgaaggctacgatcgagaggtacaagaaggcacacgccgttggctcttcctct

SEQ ID NO: 220 - protein, 151 aa, Zea mays
  VARIANT (1)...(151): Ceres Seq. ID no. 4616605
ISSSGILPLLCHLSLALAPLLFFSPAQPCFPSHPFFPLGAFSSFSLAGRPAIKPLCLQVQETAREEQAEISSMGRGRIEIKRIENNTSRQVTFCKRRNGLLKKAYELSVLCDAEVALVVFSSRGRLYEYANNSVKATIERYKKAHAVGSSS

SEQ ID NO: 221 - protein, 133 aa, Zea mays
  VARIANT (1)...(133): Ceres Seq. ID no. 4616606
SVVVAFCPCCAISLSLSLLSSFSLLLSLASRPILSFPWAHSAASAWPAGLLLNHFACKSKKLLERNKLRSPAWGGEGLRSRGSRTTRAGRSPSASAAMGSSRRRTSSPSSATPRWRSSSSPAADASTSTPTTV

SEQ ID NO: 222 - protein, 79 aa, Zea mays
  VARIANT (1)...(79): Ceres Seq. ID no. 4616607
MGRGRIEIKRIENNTSRQVTFCKRRNGLLKKAYELSVLCDAEVALVVFSSRGRLYEYANNSVKATIERYKKAHAVGSSS

SEQ ID NO: 223 - DNA, 475 bp, Zea mays
  misc_feature (1)...(475): Ceres Seq. ID no. 13633589
aaaaaaaaaaagatgcggccgttagacgagaacgagacgacggtggtcttcgagaagatcttcaaattcgtcggaaacaacctcaagaacatcgtcgagaacccatcccacgaaggacccggacccaaacccgaagccgggcgctactgcttccgcctccagaagagcagagtctactacgtaagcgagtctctcgtgaagcgagccaccaacatctcccgcaaaaacctagtctccctcggaacctgcatcgggaagtacacccacgcggggagcttccaccttacgatcatgtcgctcaacctcttggccgcgaacgcgaagcacaaggtttggcttaaacccacttcggagatgtcgtttctttacgggaaccatgtcttgaaaggagggctagggaggattaccgatagtattgtgcctggagatggggttgtcgtgttctccatgtctgatgttccgttggggtttggga

SEQ ID NO: 224 - protein, 158 aa, Zea mays
  VARIANT (1)...(158): Ceres Seq. ID no. 13633590
KKKKMRPLDENETTVVFEKIFKFVGNNLKNIVENPSHEGPGPKPEAGRYCFRLQKSRVYYVSESLVKRATNISRKNLVSLGTCIGKYTHAGSFHLTIMSLNLLAANAKHKVWLKPTSEMSFLYGNHVLKGGLGRITDSIVPGDGVVVFSMSDVPLGFG

SEQ ID NO: 225 - protein, 154 aa, Zea mays
  VARIANT (1)...(154): Ceres Seq. ID no. 13633591
MRPLDENETTVVFEKIFKFVGNNLKNIVENPSHEGPGPKPEAGRYCFRLQKSRVYYVSESLVKRATNISRKNLVSLGTCIGKYTHAGSFHLTIMSLNLLAANAKHKVWLKPTSEMSFLYGNHVLKGGLGRITDSIVPGDGVVVFSMSDVPLGFG

SEQ ID NO: 226 - protein, 112 aa, Zea mays
  VARIANT (1)...(112): Ceres Seq. ID no. 13633592
KKKDAAVRRERDDGGLREDLQIRRKQPQEHRREPIPRRTRTQTRSRALLLPPPEEQSLLRKRVSREASHQHLPQKPSLPRNLHREVHPRGELPPYDHVAQPLGREREAQGLA

SEQ ID NO: 227 - protein, 93 aa, Artificial Sequence
  consensus sequence
  VARIANT 3, 13: Xaa = Gly, or Ser
  VARIANT 4-5, 9: Xaa = Arg, or Ser
  VARIANT 6: Xaa = Ser, Arg, Ala, or Val
  VARIANT 7: Xaa = Arg, Ser, or Pro
  VARIANT 8: Xaa = Ser, Cys, or Arg
  VARIANT 10, 37: Xaa = Gln, Arg, or Ser
  VARIANT 11: Xaa = Ser, Thr, or Gln
  VARIANT 14: Xaa = Thr, Ser, Arg, or His
  VARIANT 15: Xaa = Ser, Arg, Gly, or Thr
  VARIANT 16: Xaa = Arg, Asn, or Ser
  VARIANT 18: Xaa = Ser, or Thr
  VARIANT 19-20, 24, 53, 70: Xaa = Glu, or Asp
  VARIANT 21: Xaa = Gln, or Glu
  VARIANT 22: Xaa = Ile, or Met
  VARIANT 23: Xaa = Asn, Ser, or Ala
  VARIANT 26, 86: Xaa = Ile, Val, or Leu
  VARIANT 27: Xaa = Ile, Ser, or Thr
  VARIANT 31: Xaa = Gln, His, Asp, Ser, or Ala
  VARIANT 33: Xaa = Leu, or Ile
  VARIANT 35: Xaa = Glu, or Ser
  VARIANT 36: Xaa = Leu, Ile, Ala, or Ser
  VARIANT 38: Xaa = Asp, Arg, or Ala
  VARIANT 39: Xaa = Ser, Arg, or Leu
  VARIANT 40: Xaa = Arg, or Asn
  VARIANT 41: Xaa = Arg, Gly, or Ala
  VARIANT 42: Xaa = Ser, Asn, Thr, or Ala
  VARIANT 43: Xaa = Asp, Ser, His, or Gly
  VARIANT 44: Xaa = Lys, Arg, or Gln
  VARIANT 45: Xaa = Val, Ser, Gly, or Ala
  VARIANT 46: Xaa = Ser, or Pro
  VARIANT 47-48: Xaa = Ala, Ser, or Thr
  VARIANT 49, 59: Xaa = Arg, or Lys
  VARIANT 50: Xaa = Val, or Leu
  VARIANT 52: Xaa = Gln, or Lys
  VARIANT 54, 92: Xaa = Thr, or Met
  VARIANT 56: Xaa = Asn, Thr, or Ser
  VARIANT 60, 89: Xaa = Asn, or Ser
  VARIANT 62: Xaa = His, or Gln
  VARIANT 63: Xaa = Arg, or Gln
  VARIANT 66: Xaa = Asp, or Gly
  VARIANT 67: Xaa = Asp, or Asn
  VARIANT 71: Xaa = Arg, or Thr
  VARIANT 73: Xaa = Ser, or Ala
  VARIANT 74: Xaa = Glu, Gln, or Asp
  VARIANT 75: Xaa = Leu, or Phe
  VARIANT 76: Xaa = Leu, or Met
  VARIANT 77: Xaa = Ala, Asp, or Ser
  VARIANT 78: Xaa = Asn, Thr, Ser, or Asp
  VARIANT 79: Xaa = Ser, Thr, or Pro
  VARIANT 80: Xaa = Asp, or Asn
  VARIANT 81: Xaa = Thr, Asp, Ser, or Val
  VARIANT 82: Xaa = Ala, Asn, Pro, or Thr
  VARIANT 83: Xaa = Gln, or Ser
  VARIANT 85: Xaa = Ala, or Asp
MSXXXXXXXXXSXXXXIXXXXXXXLXXKLQXLXPXXXXXXXXXXXXXXXXLXXXCXYIXXLXXEVXXLSXXLXXXXXXXXXXXAXXIRXLLXQ

SEQ ID NO: 228 - protein, 109 aa, Artificial Sequence
  consensus sequence
  VARIANT 2-11, 15-25, 32, 36, 40, 45-48, 50-55, 66, 84,87-91, 93-98: Xaa = any amino acid
  VARIANT 12, 27, 57-58, 83: Xaa = Thr, Gly, or Ala
  VARIANT 13, 14: Xaa = Arg, or Ser
  VARIANT 28, 29, 33, 63, 80: Xaa = Glu, or Asp
  VARIANT 30: Xaa = Gln, or Glu
  VARIANT 31, 35, 42, 60, 86, 102: Xaa = Ile, Leu, Val, or Met
  VARIANT 44: Xaa = Glu, or Ser
  VARIANT 49: Xaa = Arg, or Asn
  VARIANT 56: Xaa = Ser, or Pro
  VARIANT 59, 69: Xaa = His, Lys, or Arg
  VARIANT 62: Xaa = Gln, or Lys
  VARIANT 64, 108: Xaa = Thr, or Met
  VARIANT 70: Xaa = Asn, or Ser
  VARIANT 72: Xaa = His, or Gln
  VARIANT 73: Xaa = Arg, or Gln
  VARIANT 76: Xaa = Asp, or Gly
  VARIANT 77, 92: Xaa = Asp, or Asn
  VARIANT 81: Xaa = Arg, or Thr
  VARIANT 85: Xaa = Leu, or Phe
  VARIANT 99: Xaa = Gln, or Ser
  VARIANT 101: Xaa = Ala, or Asp
  VARIANT 105: Xaa = Ser, or Asn
MXXXXXXXXXXXXXXXXXXXXXXXXIXXXXXXXLXXKLQXLXPXXXXXXXXXXXXXXXXXLXXXCXYIXXLXXEVXXLSXXLXXXXXXXXXXXXXXXXXAXXIRXLLXQ

SEQ ID NO: 229 - protein, 93 aa, Artificial Sequence
  consensus sequence
  VARIANT 3, 13: Xaa = Gly, or Ser
  VARIANT 11, 14, 18, 79: Xaa = Ser, or Thr
  VARIANT 15: Xaa = Ser, or Arg
  VARIANT 16: Xaa = Arg, or Asn
  VARIANT 19, 53: Xaa = Glu, or Asp
  VARIANT 26: Xaa = Ile, or Val
  VARIANT 27: Xaa = Ile, or Ser
  VARIANT 36, 86: Xaa = Leu, or Ile
  VARIANT 48: Xaa = Ala, or Ser
  VARIANT 49: Xaa = Arg, or Lys
  VARIANT 60: Xaa = Asn, or Ser
  VARIANT 66: Xaa = Asp, or Gly
  VARIANT 77: Xaa = Ala, or Asp
  VARIANT 78: Xaa = Asn, or Thr
  VARIANT 89: Xaa = Ser, or Asn
  VARIANT 92: Xaa = Thr, or Met
MSXRRSRSRQXSXXXXIXXDQINDLXXKLQQLLPEXRDSRRSDKVSAXXVLQXTCNYIRXLHREVXDLSERLSELLXXXDTAQAAXIRXLLXQ

SEQ ID NO: 230 - protein, 93 aa, Artificial Sequence
  consensus sequence
  VARIANT 3, 11, 13, 14, 18, 48, 79: Xaa = Thr, Gly, or Ala
  VARIANT 15: Xaa = Ser, or Arg
  VARIANT 16: Xaa = Arg, or Asn
  VARIANT 19, 53: Xaa = Glu, or Asp
  VARIANT 26, 36, 86: Xaa = Ile, Leu, Val, or Met
  VARIANT 27: Xaa = Ile, or Ser
  VARIANT 39: Xaa = any amino acid
  VARIANT 49: Xaa = His, Lys, or Arg
  VARIANT 60: Xaa = Asn, or Ser
  VARIANT 66: Xaa = Asp, or Gly
  VARIANT 77: Xaa = Ala, or Asp
  VARIANT 78: Xaa = Asn, or Thr
  VARIANT 89: Xaa = Ser, or Asn
  VARIANT 92: Xaa = Thr, or Met
MSXRRSRSRQXSXXXXIXXDQINDLXXKLQQLLPEXRDXRRSDKVSAXXVLQXTCNYIRXLHREVXDLSERLSELLXXXDTAQAAXIRXLLXQ

SEQ ID NO: 231 - protein, 199 aa, Artificial Sequence
  consensus sequence
  VARIANT 2: Xaa = Glu, or Val
  VARIANT 3, 64, 88, 106, 108, 112, 161: Xaa = Ile, or Val
  VARIANT 4: Xaa = Gln, or Glu
  VARIANT 5: Xaa = Gln, or Pro
  VARIANT 6: Xaa = Ala, Gln, Val, or Pro
  VARIANT 7: Xaa = Leu, Pro, or Gln
  VARIANT 8: Xaa = Thr, Gly, or Gln
  VARIANT 9: Xaa = Asn, Gly, or Gln
  VARIANT 10: Xaa = Glu, Asp, or Val
  VARIANT 16: Xaa = Arg, or Cys
  VARIANT 18: Xaa = Thr, or Ser
  VARIANT 19: Xaa = Tyr, or Phe
  VARIANT 20: Xaa = Asp, or Glu
  VARIANT 23: Xaa = Thr, Ser, or Gln
  VARIANT 25: Xaa = Thr, Ala, Ser, or Asn
  VARIANT 30: Xaa = Val, Asn, or Ala
  VARIANT 33, 63, 82, 149, 185: Xaa = Ile, or Leu
  VARIANT 34: Xaa = Gly, or Ala
  VARIANT 36: Xaa = Gln, Thr, or Ser
  VARIANT 37, 156: Xaa = Ala, or Ser
  VARIANT 38: Xaa = Ala, Met, or Thr
  VARIANT 41: Xaa = Ala, or Tyr
  VARIANT 43, 147: Xaa = Phe, or Tyr
  VARIANT 44: Xaa = Val, or Leu
  VARIANT 47: Xaa = Thr, or Ser
  VARIANT 53, 128: Xaa = Val, or Ala
  VARIANT 91: Xaa = Ala, or Thr
  VARIANT 99: Xaa = Ser, or Thr
  VARIANT 101: Xaa = Leu, or Ala
  VARIANT 176: Xaa = Ala, or Pro
  VARIANT 180: Xaa = Ser, or Phe
  VARIANT 181: Xaa = Asn, or Lys
  VARIANT 182: Xaa = Ser, or Gln
  VARIANT 183: Xaa = Tyr, or Leu
  VARIANT 184: Xaa = Ala, or Cys
  VARIANT 186: Xaa = Lys, or Gln
  VARIANT 187: Xaa = Lys, or Glu
  VARIANT 188: Xaa = Lys, or Arg
AXXXXXXXXXVKLFNXWXXXDVXVXDISLXDYXXVXXXKHXTXXPHXAGRYSXKRFRKAQCPXXERLTNSLMMHGRNNGKKXMAVRIXKHXMEIIHLLXDXNPIQXIXDAIXNSGPREDATRIGSAGXVRRQAVDISPLRRVNQAIXLXTTGAREXAFRNXKTIAECLADELINAXKGSXXXXXXXXXDEIERVAKANR

SEQ ID NO: 232 - protein, 199 aa, Artificial Sequence; identical to SEQ ID NO: 231
  consensus sequence
  VARIANT 2: Xaa = Glu, or Val
  VARIANT 3, 33, 44, 63-64, 82, 88, 106, 108, 112, 149, 161,185: Xaa = Ile, Leu, Val, or Met
  VARIANT 4: Xaa = Gln, or Glu
  VARIANT 5: Xaa = Gln, or Pro
  VARIANT 6-10, 23, 25, 30, 36, 38: Xaa = any amino acid
  VARIANT 16: Xaa = Arg, or Cys
  VARIANT 18, 34, 37, 47, 91, 99, 156: Xaa = Thr, Gly, or Ala
  VARIANT 19, 43, 147: Xaa = Phe, Tyr, or Trp
  VARIANT 20: Xaa = Glu, or Asp
  VARIANT 41: Xaa = Ala, or Tyr
  VARIANT 53: Xaa = Val, or Ala
  VARIANT 101: Xaa = Leu, or Ala
  VARIANT 128: Xaa = Val, or Ala
  VARIANT 176: Xaa = Ala, or Pro
  VARIANT 180: Xaa = Ser, or Phe
  VARIANT 181: Xaa = Asn, or Lys
  VARIANT 182: Xaa = Ser, or Gln
  VARIANT 183: Xaa = Tyr, or Leu
  VARIANT 184: Xaa = Ala, or Cys
  VARIANT 186: Xaa = Lys, or Gln
  VARIANT 187: Xaa = Lys, or Glu
  VARIANT 188: Xaa = His, Lys, or Arg

SEQ ID NO: 233 - protein, 286 aa, Artificial Sequence
  consensus sequence
  VARIANT 4: Xaa = His, or Asn
  VARIANT 6: Xaa = Asn, or His
  VARIANT 7: Xaa = Glu, or His
  VARIANT 8: Xaa = Ile, His, or Leu
  VARIANT 9: Xaa = Val, Gly, or Leu
  VARIANT 10: Xaa = Ala, Asn, or Pro
  VARIANT 11: Xaa = Gly, or Asn
  VARIANT 12: Xaa = Gly, or Asn
  VARIANT 13: Xaa = Ile, Asn, or Leu
  VARIANT 15: Xaa = Pro, Gly, or Asp
  VARIANT 16: Xaa = Cys, Ser, or Gly
  VARIANT 20: Xaa = Ser, or Thr
  VARIANT 21: Xaa = Ser, Asp, or Pro
  VARIANT 22: Xaa = Ser, or Thr
  VARIANT 23: Xaa = Ala, Ser, or Cys
  VARIANT 24: Xaa = Ser, or Ala
  VARIANT 26: Xaa = Lys, or Arg
  VARIANT 27: Xaa = Ala, or Asp
  VARIANT 31: Xaa = Ala, or Gly
  VARIANT 34: Xaa = His, or Leu
  VARIANT 35: Xaa = Tyr, or Phe
  VARIANT 36: Xaa = His, or Pro
  VARIANT 40: Xaa = Ala, Ser, or Leu
  VARIANT 41: Xaa = Ala, or Ser
  VARIANT 43: Xaa = Val, or Leu
  VARIANT 46: Xaa = Gln, or Leu
  VARIANT 55: Xaa = Val, or Gln
  VARIANT 56: Xaa = Ala, or Gly
  VARIANT 57: Xaa = Arg, or Ser
  VARIANT 61: Xaa = Ala, Ser, or Thr
  VARIANT 62: Xaa = Cys, or Tyr
  VARIANT 63: Xaa = Ser, or Ala
  VARIANT 64: Xaa = Ser, or Lys
  VARIANT 65: Xaa = Ala, or Tyr
  VARIANT 66: Xaa = Ala, or Glu
  VARIANT 67: Xaa = Ala, Thr, Ser, or Val
  VARIANT 68: Xaa = Ala, Met, or Ile
  VARIANT 69: Xaa = Ala, Ser, or Met
  VARIANT 70: Xaa = Ala, Gly, or Ser
  VARIANT 71: Xaa = Ser, Gly, or Asp
  VARIANT 72: Xaa = Met, Asp, Ala, or Arg
  VARIANT 73: Xaa = Gly, Ala, or Ile
  VARIANT 74: Xaa = Pro, Ala, or Gly
  VARIANT 75: Xaa = Thr, Ala, Ser, or Gly
  VARIANT 76: Xaa = Gly, Ser, or Ala
  VARIANT 77: Xaa = Cys, or Ser
  VARIANT 78: Xaa = Leu, or Ile
  VARIANT 83: Xaa = Gly, or Ala
  VARIANT 96: Xaa = Val, Thr, or Ile
  VARIANT 103: Xaa = Ser, or Thr
  VARIANT 106: Xaa = Phe, or Leu
  VARIANT 111: Xaa = Val, or Leu
  VARIANT 113: Xaa = Leu, or Phe
  VARIANT 114: Xaa = Gln, or Ser
  VARIANT 115: Xaa = Arg, or His
  VARIANT 116: Xaa = Val, or Ile
  VARIANT 120: Xaa = Phe, or Leu
  VARIANT 122: Xaa = Ser, Asn, or Ala
  VARIANT 124: Xaa = Ser, Thr, or Ala
  VARIANT 125: Xaa = Leu, Ile, or Val
  VARIANT 128: Xaa = Pro, Ser, Thr, or Asp
  VARIANT 129: Xaa = Ser, or Asp
  VARIANT 130: Xaa = Ser, or Phe
  VARIANT 131: Xaa = Phe, or Ala
  VARIANT 132: Xaa = Ser, Cys, or Phe
  VARIANT 133: Xaa = Gly, or Asn
  VARIANT 134: Xaa = Tyr, Glu, or Gln
  VARIANT 135: Xaa = Gly, or Ser
  VARIANT 136: Xaa = Glu, Gly, or Ala
  VARIANT 142: Xaa = Asn, Asp, or Glu
  VARIANT 143: Xaa = Asn, or Arg
  VARIANT 148: Xaa = Glu, Lys, or Gln
  VARIANT 149: Xaa = Glu, or Asn
  VARIANT 150: Xaa = Glu, or Asp
  VARIANT 153: Xaa = Met, Leu, or Val
  VARIANT 154: Xaa = Asn, or His
  VARIANT 155: Xaa = Asn, or Glu
  VARIANT 156: Xaa = Glu, or Asn
  VARIANT 157: Xaa = Phe, Met, or Asn
  VARIANT 158: Xaa = Val, Ile, or Leu
  VARIANT 160: Xaa = Pro, or Ser
  VARIANT 166: Xaa = Glu, or Asp
  VARIANT 169: Xaa = Gly, Val, or Glu
  VARIANT 170: Xaa = Gln, or Met
  VARIANT 173: Xaa = Arg, or Lys
  VARIANT 178: Xaa = Tyr, or Cys
  VARIANT 180: Xaa = Gly, or Ser
  VARIANT 181: Xaa = Ser, or Arg
  VARIANT 183: Xaa = Lys, or Arg
  VARIANT 184: Xaa = Gln, Lys, or Ser
  VARIANT 187: Xaa = Met, or Leu
  VARIANT 190: Xaa = Arg, or Lys
  VARIANT 192: Xaa = Lys, or Asn
  VARIANT 198: Xaa = Glu, or Asp
  VARIANT 201: Xaa = Gln, Ser, or Thr
  VARIANT 202: Xaa = Gln, Ala, or Val
  VARIANT 204: Xaa = Leu, or Met
  VARIANT 205: Xaa = Asp, or Glu
  VARIANT 208: Xaa = Ser, or Asn
  VARIANT 209: Xaa = Arg, or Thr
  VARIANT 212: Xaa = Lys, or Arg
  VARIANT 217: Xaa = Ser, or Thr
  VARIANT 219: Xaa = Gln, Ser, or Glu
  VARIANT 220: Xaa = Gln, or Asp
  VARIANT 222: Xaa = Leu, Gln, or Val
  VARIANT 223: Xaa = Ala, or Arg
  VARIANT 226: Xaa = Glu, or Ala
  VARIANT 227: Xaa = Ser, Ala, or Met
  VARIANT 232: Xaa = Gln, Met, Leu, or Pro
  VARIANT 256: Xaa = Val, or Ala
  VARIANT 260: Xaa = Ala, or Pro
  VARIANT 261: Xaa = Thr, or Ser
  VARIANT 265: Xaa = His, or Asn
  VARIANT 267: Xaa = Phe, or Tyr
  VARIANT 269: Xaa = Asp, or Glu
  VARIANT 272: Xaa = Leu, or Met
  VARIANT 273: Xaa = Gly, or Cys
  VARIANT 274: Xaa = Asn, or Lys
  VARIANT 281: Xaa = Ile, or Leu
  VARIANT 283: Xaa = Ser, or His
  VARIANT 284: Xaa = Thr, or Pro
MEIXHXXXXXXXXNXXSSSXXXXXVXXKIMXHPXXXRLLXXYXNCXKVGAPPEVXXXLEEXXXXXXXXXXXXXXXXXXGEDPXLDQFMEAYCEMLXKYEQELXKPXKEAMXFXXXXECQXKXLXXSSXXXXXXXXXTAIDRXXNGSSXXXVDXXXXXXDXQAEDRXLKXXLLXKYSGXLXXLXXEFXKKXKXGKLPKXARXXLXXWWXXHYXWPYPXEXXKXXLAXXTGLDXKQINNWFINQRKRHWKPSEDMQFXVMDXXHPHXYXMXNVXXXPFPMDHXSXXML

SEQ ID NO: 234 - protein, 294 aa, Artificial Sequence
  consensus sequence
  VARIANT 4-11, 14, 16-22, 24, 41, 68-72, 74-80, 83-84,104, 130, 136-140, 142, 144-153, 156, 164-165,177, 192, 209-210, 227, 230, 235, 240, 270-272,288: Xaa = any amino acid
  VARIANT 12-13: Xaa = Gly, or Asn
  VARIANT 23, 25, 32, 42, 57, 62, 64, 73, 81-82, 91, 111,132, 143, 188, 225, 269: Xaa = Thr, Gly, or Ala
  VARIANT 27, 123, 181, 191, 198, 220: Xaa = His, Lys, or Arg
  VARIANT 28: Xaa = Ala, or Asp
  VARIANT 35: Xaa = His, or Leu
  VARIANT 36, 275: Xaa = Phe, Tyr, or Trp
  VARIANT 37: Xaa = His, or Pro
  VARIANT 44, 86, 119, 124, 133, 161, 166, 195, 212, 280,289: Xaa = Ile, Leu, Val, or Met
  VARIANT 47: Xaa = Gln, or Leu
  VARIANT 56: Xaa = Val, or Gln
  VARIANT 58: Xaa = Arg, or Ser
  VARIANT 63: Xaa = Cys, or Tyr
  VARIANT 65: Xaa = Ser, or Lys
  VARIANT 66: Xaa = Ala, or Tyr
  VARIANT 67: Xaa = Ala, or Glu
  VARIANT 85: Xaa = Cys, or Ser
  VARIANT 114, 121, 128: Xaa = Phe, or Leu
  VARIANT 122: Xaa = Gln, or Ser
  VARIANT 141: Xaa = Gly, or Asn
  VARIANT 157: Xaa = Glu, or Asn
  VARIANT 158, 174, 206, 213, 277: Xaa = Glu, or Asp
  VARIANT 162: Xaa = Asn, or His
  VARIANT 163: Xaa = Asn, or Glu
  VARIANT 168: Xaa = Pro, or Ser
  VARIANT 178: Xaa = Gln, or Met
  VARIANT 186: Xaa = Tyr, or Cys
  VARIANT 189: Xaa = Ser, or Arg
  VARIANT 200: Xaa = Lys, or Asn
  VARIANT 216: Xaa = Ser, or Asn
  VARIANT 217: Xaa = Arg, or Thr
  VARIANT 228: Xaa = Gln, or Asp
  VARIANT 231: Xaa = Ala, or Arg
  VARIANT 234: Xaa = Glu, or Ala
  VARIANT 264: Xaa = Val, or Ala
  VARIANT 268: Xaa = Ala, or Pro
  VARIANT 273: Xaa = His, or Asn
  VARIANT 281: Xaa = Gly, or Cys
  VARIANT 282: Xaa = Asn, or Lys
  VARIANT 291: Xaa = Ser, or His
  VARIANT 292: Xaa = Thr, or Pro
MEIXXXXXXXXXXXNXXXXXXXXXXVXXKIMXHPXXXRLLXXYXNCXKVGAPPEVXXXLEEXXXXXXXXXXXXXXXXXXXXXXXXXGEDPXLDQFMEAYCEMLXKYEQELXKPXKEAMXFXXXXECQXKXLXXSSXXXXXXXXXXXXXXXXXXSSXXXVDXXXXXXDXQAEDRXLKXXLLXKYSGXLXXLXXEFXKKXKXGKLPKXARXXLXXWWXXHYXWPYPXEXXKXXLAXXTGLDXKQINNWFINQRKRHWKPSEDMQFXVMDXXXXXXYXMXNVXXXPFPMDXXSXXML

SEQ ID NO: 235 - protein, 286 aa, Artificial Sequence
  consensus sequence
  VARIANT 4: Xaa = His, or Asn
  VARIANT 6: Xaa = Asn, or His
  VARIANT 7: Xaa = Glu, or His
  VARIANT 8: Xaa = Ile, His, or Leu
  VARIANT 9: Xaa = Val, Gly, or Leu
  VARIANT 10: Xaa = Ala, Asn, or Pro
  VARIANT 11: Xaa = Gly, or Asn
  VARIANT 12: Xaa = Gly, or Asn
  VARIANT 13: Xaa = Ile, Asn, or Leu
  VARIANT 15: Xaa = Pro, Gly, or Asp
  VARIANT 16: Xaa = Cys, Ser, or Gly
  VARIANT 20: Xaa = Ser, or Thr
  VARIANT 21: Xaa = Ser, Asp, or Pro
  VARIANT 22: Xaa = Ser, or Thr
  VARIANT 23: Xaa = Ala, Ser, or Cys
  VARIANT 24: Xaa = Ser, or Ala
  VARIANT 26: Xaa = Lys, or Arg
  VARIANT 27: Xaa = Ala, or Asp
  VARIANT 31: Xaa = Ala, or Gly
  VARIANT 34: Xaa = His, or Leu
  VARIANT 35: Xaa = Tyr, or Phe
  VARIANT 36: Xaa = His, or Pro
  VARIANT 40: Xaa = Ala, Ser, or Leu
  VARIANT 41: Xaa = Ala, or Ser
  VARIANT 43: Xaa = Val, or Leu
  VARIANT 46: Xaa = Gln, or Leu
  VARIANT 55: Xaa = Val, or Gln
  VARIANT 56: Xaa = Ala, or Gly
  VARIANT 57: Xaa = Arg, or Ser
  VARIANT 61: Xaa = Ala, Ser, or Thr
  VARIANT 62: Xaa = Cys, or Tyr
  VARIANT 63: Xaa = Ser, or Ala
  VARIANT 64: Xaa = Ser, or Lys
  VARIANT 65: Xaa = Ala, or Tyr
  VARIANT 66: Xaa = Ala, or Glu
  VARIANT 67: Xaa = Ala, Thr, Ser, or Val
  VARIANT 68: Xaa = Ala, Met, or Ile
  VARIANT 69: Xaa = Ala, Ser, or Met
  VARIANT 70: Xaa = Ala, Gly, or Ser
  VARIANT 71: Xaa = Ser, Gly, or Asp
  VARIANT 72: Xaa = Met, Asp, Ala, or Arg
  VARIANT 73: Xaa = Gly, Ala, or Ile
  VARIANT 74: Xaa = Pro, Ala, or Gly
  VARIANT 75: Xaa = Thr, Ala, Ser, or Gly
  VARIANT 76: Xaa = Gly, Ser, or Ala
  VARIANT 77: Xaa = Cys, or Ser
  VARIANT 78: Xaa = Leu, or Ile
  VARIANT 83: Xaa = Gly, or Ala
  VARIANT 96: Xaa = Val, Thr, or Ile
  VARIANT 103: Xaa = Ser, or Thr
  VARIANT 106: Xaa = Phe, or Leu
  VARIANT 111: Xaa = Val, or Leu
  VARIANT 113: Xaa = Leu, or Phe
  VARIANT 114: Xaa = Gln, or Ser
  VARIANT 115: Xaa = Arg, or His
  VARIANT 116: Xaa = Val, or Ile
  VARIANT 120: Xaa = Phe, or Leu
  VARIANT 122: Xaa = Ser, Asn, or Ala
  VARIANT 124: Xaa = Ser, Thr, or Ala
  VARIANT 125: Xaa = Leu, Ile, or Val
  VARIANT 128: Xaa = Pro, Ser, Thr, or Asp
  VARIANT 129: Xaa = Ser, or Asp
  VARIANT 130: Xaa = Ser, or Phe
  VARIANT 131: Xaa = Phe, or Ala
  VARIANT 132: Xaa = Ser, Cys, or Phe
  VARIANT 133: Xaa = Gly, or Asn
  VARIANT 134: Xaa = Tyr, Glu, or Gln
  VARIANT 135: Xaa = Gly, or Ser
  VARIANT 136: Xaa = Glu, Gly, or Ala
  VARIANT 142: Xaa = Asn, Asp, or Glu
  VARIANT 143: Xaa = Asn, or Arg
  VARIANT 148: Xaa = Glu, Lys, or Gln
  VARIANT 149: Xaa = Glu, or Asn
  VARIANT 150: Xaa = Glu, or Asp
  VARIANT 153: Xaa = Met, Leu, or Val
  VARIANT 154: Xaa = Asn, or His
  VARIANT 155: Xaa = Asn, or Glu
  VARIANT 156: Xaa = Glu, or Asn
  VARIANT 157: Xaa = Phe, Met, or Asn
  VARIANT 158: Xaa = Val, Ile, or Leu
  VARIANT 160: Xaa = Pro, or Ser
  VARIANT 166: Xaa = Glu, or Asp
  VARIANT 169: Xaa = Gly, or Val
  VARIANT 184: Xaa = Gln, or Lys
  VARIANT 187: Xaa = Met, or Leu
  VARIANT 190: Xaa = Arg, or Lys
  VARIANT 192: Xaa = Lys, or Asn
  VARIANT 205: Xaa = Asp, or Glu
  VARIANT 208: Xaa = Ser, or Asn
  VARIANT 219: Xaa = Gln, or Ser
  VARIANT 222: Xaa = Leu, or Gln
  VARIANT 232: Xaa = Gln, Met, or Leu
  VARIANT 256: Xaa = Val, or Ala
  VARIANT 260: Xaa = Ala, or Pro
  VARIANT 261: Xaa = Thr, or Ser
  VARIANT 265: Xaa = His, or Asn
  VARIANT 267: Xaa = Phe, or Tyr
  VARIANT 269: Xaa = Asp, or Glu
  VARIANT 272: Xaa = Leu, or Met
  VARIANT 273: Xaa = Gly, or Cys
  VARIANT 274: Xaa = Asn, or Lys
  VARIANT 284: Xaa = Ile, or Leu
  VARIANT 283: Xaa = Ser, or His
  VARIANT 284: Xaa = Thr, or Pro
MEIXHXXXXXXXXNXXSSSXXXXXVXXKIMXHPXXXRLLXXYXNCXKVGAPPEVXXXLEEXXXXXXXXXXXXXXXXXXGEDPXLDQFMEAYCEMLXKYEQELXKPXKEAMXFXXXXECQXKXLXXSSXXXXXXXXXTAIDRXXNGSSXXXVDXXXXXXDXQAEDRXLKXQLLRKYSGYLGSLKXEFXKKXKXGKLPKEARQQLLXWWXRHYKWPYPSEXQKXALAESTGLDXKQINNWFINQRKRHWKPSEDMQFXVMDXXHPHXYXMXNVXXXPFPMDHXSXXML

SEQ ID NO: 236 - protein, 294 aa, Artificial Sequence
  consensus sequence
  VARIANT 4-11, 14, 16-22, 24, 41, 68-72, 74-80, 83-84, 104,130, 136-140, 142, 144-153, 156, 164-165, 240,270-272, 288: Xaa = any amino acid
  VARIANT 12-13: Xaa = Gly, or Asn
  VARIANT 23, 25, 32, 42, 57, 62, 64, 73, 81-82, 91, 111,132, 143, 269: Xaa = Thr, Gly, or Ala
  VARIANT 27, 123, 198: Xaa = His, Lys, or Arg
  VARIANT 28: Xaa = Ala, or Asp
  VARIANT 35: Xaa = His, or Leu
  VARIANT 36, 275: Xaa = Phe, Tyr, or Trp
  VARIANT 37: Xaa = His, or Pro
  VARIANT 44, 86, 119, 124, 133, 161, 166, 195, 280, 289: Xaa = Ile, Leu, Val, or Met
  VARIANT 47: Xaa = Gln, or Leu
  VARIANT 56: Xaa = Val, or Gln
  VARIANT 58: Xaa = Arg, or Ser
  VARIANT 63: Xaa = Cys, or Tyr
  VARIANT 65: Xaa = Ser, or Lys
  VARIANT 66: Xaa = Ala, or Tyr
  VARIANT 67: Xaa = Ala, or Glu
  VARIANT 85: Xaa = Cys, or Ser
  VARIANT 114: Xaa = Phe, or Leu
  VARIANT 121: Xaa = Leu, or Phe
  VARIANT 122: Xaa = Gln, or Ser
  VARIANT 128: Xaa = Phe, or Leu
  VARIANT 141: Xaa = Gly, or Asn
  VARIANT 157: Xaa = Glu, or Asn
  VARIANT 158, 174, 213, 277: Xaa = Glu, or Asp
  VARIANT 162: Xaa = Asn, or His
  VARIANT 163: Xaa = Asn, or Glu
  VARIANT 168: Xaa = Pro, or Ser
  VARIANT 177: Xaa = Gly, or Val
  VARIANT 192: Xaa = Gln, or Lys
  VARIANT 200: Xaa = Lys, or Asn
  VARIANT 216: Xaa = Ser, or Asn
  VARIANT 227: Xaa = Gln, or Ser
  VARIANT 230: Xaa = Leu, or Gln
  VARIANT 264: Xaa = Val, or Ala
  VARIANT 268: Xaa = Ala, or Pro
  VARIANT 273: Xaa = His, or Asn
  VARIANT 281: Xaa = Gly, or Cys
  VARIANT 282: Xaa = Asn, or Lys
  VARIANT 291: Xaa = Ser, or His
  VARIANT 292: Xaa = Thr, or Pro
MEIXXXXXXXXXXXNXXXXXXXXXXVXXKIMXHPXXXRLLXXYXNCXKVGAPPEVXXXLEEXXXXXXXXXXXXXXXXXXXXXXXXXGEDPXLDQFMEAYCEMLXKYEQELXKPXKEAMXFXXXXECQXKXLXXSSXXXXXXXXXXXXXXXXXXSSXXXVDXXXXXXDXQAEDRXLKXQLLRKYSGYLGSLKXEFXKKXKXGKLPKEARQQLLXWWXRHYKWPYPSEXQKXALAESTGLDXKQINNWFINQRKRHWKPSEDMQFXVMDXXXXXXYXMXNVXXXPFPMDXXSXXML

SEQ ID NO: 237 - protein, 85 aa, Artificial Sequence
  consensus sequence
  VARIANT 3: Xaa = Ala, or Ser
  VARIANT 4: Xaa = Ser, or Thr
  VARIANT 9: Xaa = Met, or Ile
  VARIANT 15: Xaa = Ser, or Ala
  VARIANT 23: Xaa = Ala, or Thr
  VARIANT 26: Xaa = Ser, or Leu
  VARIANT 27: Xaa = Arg, or Lys
  VARIANT 28: Xaa = Pro, Ser, or Ala
  VARIANT 29: Xaa = Ile, Thr, Glu, or Pro
  VARIANT 31: Xaa = Asp, or Glu
  VARIANT 33: Xaa = Lys, Cys, or Arg
  VARIANT 34: Xaa = Arg, or Lys
  VARIANT 36: Xaa = Glu, or Gln
  VARIANT 37: Xaa = Met, Thr, or Ser
  VARIANT 38: Xaa = Ile, or Val
  VARIANT 39: Xaa = Val, or Ile
  VARIANT 40: Xaa = Ser, or Phe
  VARIANT 41: Xaa = Thr, Gln, or Ala
  VARIANT 45: Xaa = His, Lys, Arg, or Asp
  VARIANT 47: Xaa = Ser, or Ala
  VARIANT 48: Xaa = Lys, Glu, or Arg
  VARIANT 49: Xaa = Glu, Asp, or Ser
  VARIANT 53: Xaa = Lys, or Arg
  VARIANT 56: Xaa = Gln, Leu, or Val
  VARIANT 57: Xaa = Tyr, or His
  VARIANT 64: Xaa = Leu, or Arg
  VARIANT 65: Xaa = Gly, or Ala
  VARIANT 66: Xaa = Thr, His, Asn, or Lys
  VARIANT 70: Xaa = Asp, or Glu
  VARIANT 74: Xaa = Ser, or Asn
  VARIANT 76: Xaa = Ala, Asp, or Gly
  VARIANT 77: Xaa = Ile, Met, or Thr
  VARIANT 78: Xaa = Val, or Thr
  VARIANT 79: Xaa = Ser, or Gly
  VARIANT 80: Xaa = Leu, or Ile
  VARIANT 81: Xaa = Ser, or Ala
  VARIANT 82: Xaa = Ser, or Thr
  VARIANT 83: Xaa = Ile, Val, or Leu
  VARIANT 84: Xaa = Lys, Gln, or Val
  VARIANT 85: Xaa = Val, Ile, or Leu,
MGXXKLSGXQKQVLXLYRGFLRXARXXXXEXRXXIXXXXXXEFRXNXXXVDRXNFXXIEYLLRXXXKQLXQLKXPXXXXXXXXXX

SEQ ID NO: 238 - protein, 89 aa, Artificial Sequence
  consensus sequence
  VARIANT 3, 4, 18, 26, 51, 69, 83, 85, 86: Xaa = Thr, Gly, or Ala
  VARIANT 6-8, 30-33, 37, 41, 45, 49, 52-53, 60, 70, 80-81,88: Xaa = any amino acid
  VARIANT 12, 42-43, 84, 87, 89: Xaa = Ile, Leu, Val, or Met
  VARIANT 29: Xaa = Ser, or Leu
  VARIANT 35, 74: Xaa = Glu, or Asp
  VARIANT 38, 57: Xaa = His, Lys, or Arg
  VARIANT 40: Xaa = Glu, or Gln
  VARIANT 44: Xaa = Ser, or Phe
  VARIANT 61: Xaa = Tyr, or His
  VARIANT 68: Xaa = Leu, or Arg
  VARIANT 78: Xaa = Ser, or Asn
  VARIANT 82: Xaa = Val, or Thr
MGXXKXXXLSGXQKQVLXLYRGFLRXARXXXXXEXRXXIXXXXXXEFRXNXXXVDRXNFXXIEYLLRXXXKQLXQLKXPXXXXXXXXXX

SEQ ID NO: 239 - protein, 84 aa, Artificial Sequence
  consensus sequence
  VARIANT 3: Xaa = Ala, or Ser
  VARIANT 4: Xaa = Ser, or Thr
  VARIANT 27: Xaa = Arg, or Lys
  VARIANT 28: Xaa = Pro, or Ser
  VARIANT 29: Xaa = Ile, Thr, or Glu
  VARIANT 31: Xaa = Asp, or Glu
  VARIANT 33: Xaa = Lys, or Cys
  VARIANT 34: Xaa = Arg, or Lys
  VARIANT 36: Xaa = Glu, or Gln
  VARIANT 37: Xaa = Met, Thr, or Ser
  VARIANT 38: Xaa = Ile, or Val
  VARIANT 39: Xaa = Val, or Ile
  VARIANT 41: Xaa = Thr, or Gln
  VARIANT 45: Xaa = His, Lys, or Arg
  VARIANT 47: Xaa = Ser, or Ala
  VARIANT 48: Xaa = Lys, or Glu
  VARIANT 49: Xaa = Glu, or Asp
  VARIANT 56: Xaa = Gln, or Leu
  VARIANT 60: Xaa = Tyr, or Leu
  VARIANT 63: Xaa = Leu, or Arg
  VARIANT 64: Xaa = Gly, or Ala
  VARIANT 65: Xaa = Thr, His, or Asn
  VARIANT 73: Xaa = Ser, or Asn
  VARIANT 75: Xaa = Ala, Asp, or Gly
  VARIANT 76: Xaa = Ile, Met, or Thr
  VARIANT 77: Xaa = Val, or Thr
  VARIANT 78: Xaa = Ser, or Gly
  VARIANT 79: Xaa = Leu, or Ile
  VARIANT 82: Xaa = Ile, Val, or Leu
  VARIANT 83: Xaa = Lys, or Gln
  VARIANT 84: Xaa = Val, Ile, or Leu
MGXXKLSGMQKQVLSLYRGFLRAARSXXXEXRXXIXXXXSXEFRXNXXXVDRKNFXYIEXLRXXXKQLDQLKXPXXXXXSSXXX

SEQ ID NO: 240 - protein, 89 aa, Artificial Sequence
  consensus sequence
  VARIANT 3-4, 51, 69, 83: Xaa = Thr, Gly, or Ala
  VARIANT 6-8, 30-33, 41, 70, 80-81: Xaa = any amino acid
  VARIANT 35, 53: Xaa = Glu, or Asp
  VARIANT 37: Xaa = Lys, or Cys
  VARIANT 38, 49: Xaa = His, Lys, or Arg
  VARIANT 40: Xaa = Glu, or Gln
  VARIANT 42-43, 84, 87, 89: Xaa = Ile, Leu, Val, or Met
  VARIANT 45: Xaa = Thr, or Gln
  VARIANT 52: Xaa = Lys, or Glu
  VARIANT 60: Xaa = Gln, or Leu
  VARIANT 68: Xaa = Leu, or Arg
  VARIANT 78: Xaa = Ser, or Asn
  VARIANT 82: Xaa = Val, or Thr
  VARIANT 88: Xaa = Lys, or Gln
MGXXKXXXLSGMQKQVLSLYRGFLRAARSXXXXEXRXXIXXXXSXEFRXNXXXVDRKNFXYIEYLLRXXXKQLDQLKXPXXXXXSSXXX

SEQ ID NO: 241 - protein, 185 aa, Artificial Sequence
  consensus sequence
  VARIANT 3: Xaa = Pro, or Ala
  VARIANT 7: Xaa = Thr, Lys, or Asn
  VARIANT 10: Xaa = Thr, Ser, or Lys
  VARIANT 11: Xaa = Val, Ala, Met, or Gln
  VARIANT 16: Xaa = Leu, or Ile
  VARIANT 20: Xaa = Val, or Thr
  VARIANT 22: Xaa = Asn, or Pro
  VARIANT 26: Xaa = Lys, Asn, or His
  VARIANT 27: Xaa = Ile, or Leu
  VARIANT 28: Xaa = Val, or Leu
  VARIANT 30: Xaa = Asn, or Arg
  VARIANT 32: Xaa = Ser, or Ala
  VARIANT 33: Xaa = Asp, His, or Val
  VARIANT 37: Xaa = Glu, Asp, or Gly
  VARIANT 38: Xaa = Ser, Pro, or Ala
  VARIANT 39: Xaa = Thr, Asn, Lys, Glu, or Gln
  VARIANT 40: Xaa = Pro, or Ala
  VARIANT 42: Xaa = Ser, or Arg
  VARIANT 45: Xaa = Phe, or Leu
  VARIANT 48: Xaa = Gln, or His
  VARIANT 49: Xaa = Lys, or Arg
  VARIANT 50: Xaa = Asn, or Ser
  VARIANT 51: Xaa = Arg, or Lys
  VARIANT 52: Xaa = Val, or Ile
  VARIANT 53: Xaa = Tyr, or Phe
  VARIANT 55: Xaa = Val, or Ala
  VARIANT 58: Xaa = Ala, or Ser
  VARIANT 60: Xaa = Val, Lys, or Arg
  VARIANT 64: Xaa = Asn, or Ala
  VARIANT 65: Xaa = Ile, or Val
  VARIANT 66: Xaa = Ser, or Ala
  VARIANT 68: Xaa = Lys, Pro, or Thr
  VARIANT 69: Xaa = Asn, or Arg
  VARIANT 71: Xaa = Val, or Ala
  VARIANT 72: Xaa = Ser, or Gly
  VARIANT 73: Xaa = Phe, Leu, or Val
  VARIANT 76: Xaa = Cys, or Pro
  VARIANT 80: Xaa = Tyr, or Phe
  VARIANT 83: Xaa = Ala, Gly, or His
  VARIANT 85: Xaa = Ser, or Ala
  VARIANT 90: Xaa = Ile, or Val
  VARIANT 91: Xaa = Met, Gln, or His
  VARIANT 92: Xaa = Ser, or Ala
  VARIANT 94: Xaa = Asn, or Asp
  VARIANT 95: Xaa = Ile, or Leu
  VARIANT 98: Xaa = Ala, or Val
  VARIANT 99: Xaa = Asn, or His
  VARIANT 101: Xaa = Lys, or Arg
  VARIANT 102: Xaa = His, or Arg
  VARIANT 103: Xaa = Lys, or Arg
  VARIANT 104: Xaa = Val, or Ile
  VARIANT 109: Xaa = Thr, Gln, or Asp
  VARIANT 110: Xaa = Ser, or Thr
  VARIANT 112: Xaa = Met, or Arg
  VARIANT 116: Xaa = Tyr, or Phe
  VARIANT 119: Xaa = His, Ser, or Val
  VARIANT 120: Xaa = Leu, or Pro
  VARIANT 122: Xaa = Gly, or Ser
  VARIANT 123: Xaa = Gly, Ala, or Ser
  VARIANT 125: Xaa = Gly, or Ala
  VARIANT 126: Xaa = Arg, or Lys
  VARIANT 127: Xaa = Ile, or Leu
  VARIANT 128: Xaa = Thr, or Ser
  VARIANT 129: Xaa = Asp, or Glu
  VARIANT 130: Xaa = Ser, or Asn
  VARIANT 131: Xaa = Ile, or Thr
  VARIANT 132: Xaa = Val, Ala, or Lys
  VARIANT 133: Xaa = Pro, Ala, or Ser
  VARIANT 134: Xaa = Gly, or Asn
  VARIANT 140: Xaa = Phe, or Met
  VARIANT 143: Xaa = Ser, or Ala
  VARIANT 151: Xaa = Ile, or Val
  VARIANT 154: Xaa = Lys, or Arg
  VARIANT 155: Xaa = Ser, or Gly
  VARIANT 156: Xaa = Thr, or Ala
  VARIANT 157: Xaa = Gln, or Leu
  VARIANT 162: Xaa = Leu, or Ala
  VARIANT 164: Xaa = Pro, or Thr
  VARIANT 166: Xaa = Gly, or Ala
  VARIANT 167: Xaa = Ile, or Val
  VARIANT 173: Xaa = Ala, or Ser
  VARIANT 175: Xaa = Ile, Val, or Ala
  VARIANT 181: Xaa = Gly, Met, Lys, or Arg
  VARIANT 183: Xaa = Asp, or Glu
  VARIANT 184: Xaa = Asp, or Glu
MRXLDEXETXXVFEKXFKFXGXNLKXXXEXPXXEGPXXXXGXYCXRLXXXXXXYXSEXLXRATXXXRXXLXXXGTXIGKXTHXGXFHLTXXXLXXLAXXAXXXXWLKPXXEXSFLXGNXXKXXLXXXXXXXXXXDGVVVXSMXDVPLGFGXAAXXXXDCRKXDXNXXVVLHQXDXGEYLRXEXXL

SEQ ID NO: 242 - protein, 189 aa, Artificial Sequence
  consensus sequence
  VARIANT 3: Xaa = Pro, or Ala
  VARIANT 7, 10-11, 26, 33, 37-39, 41-42, 71, 76, 86, 94,112, 136-137, 179, 185: Xaa = any amino acid
  VARIANT 16, 27, 28, 54, 68, 93, 98, 107, 131, 155, 171: Xaa = Ile, Leu, Val, or Met
  VARIANT 20: Xaa = Val, or Thr
  VARIANT 22: Xaa = Asn, or Pro
  VARIANT 30: Xaa = Asn, or Arg
  VARIANT 32, 60, 69, 75, 88, 95, 113, 126-127, 129, 132,147, 159-160, 170, 177: Xaa = Thr, Gly, or Ala
  VARIANT 40: Xaa = Pro, or Ala
  VARIANT 44: Xaa = Ser, or Arg
  VARIANT 47: Xaa = Phe, or Leu
  VARIANT 50: Xaa = Gln, or His
  VARIANT 51, 53, 63, 104-106, 130, 158: Xaa = His, Lys, or Arg
  VARIANT 52: Xaa = Asn, or Ser
  VARIANT 55, 83, 119: Xaa = Phe, Tyr, or Trp
  VARIANT 57: Xaa = Val, or Ala
  VARIANT 67: Xaa = Asn, or Ala
  VARIANT 72: Xaa = Asn, or Arg
  VARIANT 74: Xaa = Val, or Ala
  VARIANT 79: Xaa = Cys, or Pro
  VARIANT 97: Xaa = Asn, or Asp
  VARIANT 101: Xaa = Ala, or Val
  VARIANT 102: Xaa = Asn, or His
  VARIANT 115: Xaa = Met, or Arg
  VARIANT 122: Xaa = His, or Ser
  VARIANT 124: Xaa = Leu, or Pro
  VARIANT 133, 187, 188: Xaa = Glu, or Asp
  VARIANT 134: Xaa = Ser, or Asn
  VARIANT 135: Xaa = Ile, or Thr
  VARIANT 138: Xaa = Gly, or Asn
  VARIANT 144: Xaa = Phe, or Met
  VARIANT 161: Xaa = Gln, or Leu
  VARIANT 166: Xaa = Leu, or Ala
  VARIANT 168: Xaa = Pro, or Thr
MRXLDEXETXXVFEKXFKFXGXNLKXXXEXPXXEGPXXXXXXGXYCXRLXXXXXXYXSEXLVXRATXXXRXXLXXXGTXIGKXTHXGXFHLTXXXLXXLAXXAXXXXWLKPXXEXSFLXGNXVXKXXLXXXXXXXXXXDGVVVXSMXDVPLGFGXAAXXXXDCRKXDXNXXVVLHQXDXGEYLRXEXXL

SEQ ID NO: 243 - protein, 116 aa, Artificial Sequence
  consensus sequence
  VARIANT 1: Xaa = Val, or Ala
  VARIANT 3: Xaa = Ile, Val, or Leu
  VARIANT 5: Xaa = Asp, or Glu
  VARIANT 7: Xaa = Asp, Asn, or Ile
  VARIANT 8: Xaa = Pro, Ile, or Lys
  VARIANT 9: Xaa = Leu, or Val
  VARIANT 10: Xaa = Asn, or Ile
  VARIANT 11: Xaa = Arg, or Leu
  VARIANT 12: Xaa = Arg, Lys, Ile, or Met
  VARIANT 13, 18, 37, 47, 66, 109, 112, 113, 116: Xaa = Leu, or Ile
  VARIANT 14: Xaa = His, or Leu
  VARIANT 15: Xaa = Glu, Gln, or Ser
  VARIANT 16: Xaa = Met, Ile, Lys, Asn, or Gln
  VARIANT 17: Xaa = Ile, Leu, or Met
  VARIANT 19: Xaa = Lys, Glu, or Arg
  VARIANT 20: Xaa = Thr, Ser, Ala, or Lys
  VARIANT 21: Xaa = Ile, Val, or Phe
  VARIANT 22: Xaa = Gly, or Gln
  VARIANT 23: Xaa = Gly, or Val
  VARIANT 24: Xaa = Ile, Lys, or Glu
  VARIANT 25: Xaa = Ser, Asn, or Thr
  VARIANT 26: Xaa = Gln, or Thr
  VARIANT 27: Xaa = Thr, Gly, or Val
  VARIANT 28: Xaa = Ala, or Val
  VARIANT 29: Xaa = Lys, Asn, Glu, or Gln
  VARIANT 32: Xaa = Glu, Gln, or Lys
  VARIANT 36: Xaa = Ile, Asn, Asp, or Glu
  VARIANT 38: Xaa = His, or Phe
  VARIANT 39: Xaa = Arg, Cys, or Leu
  VARIANT 40: Xaa = Asp, His, or Gly
  VARIANT 42: Xaa = Glu, Asn, Gly, or Gln
  VARIANT 43: Xaa = Ala, Ser, or Ile
  VARIANT 44: Xaa = Ser, or Thr
  VARIANT 48, 76: Xaa = Ile, or Val
  VARIANT 50: Xaa = Met, or Thr
  VARIANT 52: Xaa = Lys, Met, or Asn
  VARIANT 53: Xaa = Glu, Asp, or Leu
  VARIANT 56: Xaa = Glu, or Ile
  VARIANT 57: Xaa = Arg, or Met
  VARIANT 58: Xaa = Asp, Asn, or Thr
  VARIANT 60: Xaa = Val, Leu, Ile, or Pro
  VARIANT 61: Xaa = Ser, or Glu
  VARIANT 62: Xaa = Thr, or Ala
  VARIANT 63: Xaa = Thr, or Ile
  VARIANT 64: Xaa = Lys, or Ser
  VARIANT 65: Xaa = Lys, or Glu
  VARIANT 68: Xaa = Glu, Ser, or Ala
  VARIANT 70: Xaa = Lys, Glu, or Gly
  VARIANT 71: Xaa = Val, Ile, or Ala
  VARIANT 72: Xaa = Thr, Lys, or Gly
  VARIANT 73: Xaa = Ser, or Asp
  VARIANT 79: Xaa = Thr, or Ser
  VARIANT 80: Xaa = Ser, Thr, or Val
  VARIANT 81: Xaa = Leu, Arg, or Asp
  VARIANT 82: Xaa = Ala, or Cys
  VARIANT 83: Xaa = Asp, Thr, or Asn
  VARIANT 84: Xaa = Gln, Asn, Glu, or Ser
  VARIANT 85: Xaa = Glu, Ala, or Met
  VARIANT 87: Xaa = Glu, or Ile
  VARIANT 89: Xaa = Lys, or Arg
  VARIANT 92: Xaa = Met, or Lys
  VARIANT 93: Xaa = Glu, or Asp
  VARIANT 96: Xaa = Leu, or Ala
  VARIANT 97: Xaa = Asn, or Asp
  VARIANT 98: Xaa = His, Asp, or Leu
  VARIANT 99: Xaa = Cys, or Tyr
  VARIANT 100: Xaa = Leu, His, or Val
  VARIANT 101: Xaa = Glu, Ala, or Pro
  VARIANT 105: Xaa = Thr, Ser, or Asn
  VARIANT 106: Xaa = Lys, or Asn
  VARIANT 107: Xaa = Ala, or Asp
  VARIANT 110: Xaa = Phe, Leu, Ile, or Ser
  VARIANT 111: Xaa = Pro, or Ser
  VARIANT 114: Xaa = Ser, Asn, or Asp
  VARIANT 115: Xaa = His, Asn, Gln, or Lys
XLXVXDXXXXXXXXXXXXXXXXXXXXXXXNGXEAVXXXXXGXXXFDXXLXDXXMPXXXGXXXXXXXRXMXXXXMIXGVXXXXXXXEXRXAFXXAGXXXXXXKPLXXXKXXXXXXXX

SEQ ID NO: 244 - protein, 117 aa, Artificial Sequence
  consensus sequence
  VARIANT 1: Xaa = Val, or Ala
  VARIANT 3, 9, 13, 17-18, 37, 47-48, 66, 77, 110, 113-114,117: Xaa = Ile, Leu, Val, or Met
  VARIANT 5, 94: Xaa = Glu, or Asp
  VARIANT 7-8, 12, 15-16, 19-21, 24-25, 27, 29, 32, 36,39-40, 42-44, 52-53, 58, 60, 68, 70-72, 74, 81-82,84-86, 89-91, 99, 101-102, 106, 111, 115-116: Xaa = any amino acid
  VARIANT 10: Xaa = Asn, or Ile
  VARIANT 11: Xaa = Arg, or Leu
  VARIANT 14: Xaa = His, or Leu
  VARIANT 22: Xaa = Gly, or Gln
  VARIANT 23: Xaa = Gly, or Val
  VARIANT 26: Xaa = Gln, or Thr
  VARIANT 28: Xaa = Ala, or Val
  VARIANT 38: Xaa = His, or Phe
  VARIANT 50: Xaa = Met, or Thr
  VARIANT 56: Xaa = Glu, or Ile
  VARIANT 57: Xaa = Arg, or Met
  VARIANT 61: Xaa = Ser, or Glu
  VARIANT 62, 80: Xaa = Thr, Gly, or Ala
  VARIANT 63: Xaa = Thr, or Ile
  VARIANT 64: Xaa = Lys, or Ser
  VARIANT 65: Xaa = Lys, or Glu
  VARIANT 73: Xaa = Ser, or Asp
  VARIANT 83: Xaa = Ala, or Cys
  VARIANT 88: Xaa = Glu, or Ile
  VARIANT 93: Xaa = Met, or Lys
  VARIANT 97: Xaa = Leu, or Ala
  VARIANT 98: Xaa = Asn, or Asp
  VARIANT 100: Xaa = Cys, or Tyr
  VARIANT 107: Xaa = Lys, or Asn
  VARIANT 108: Xaa = Ala, or Asp
  VARIANT 112: Xaa = Pro, or Ser
XLXVXDXXXXXXXXXXXXXXXXXXXXXXXNGXEAVXXXXXGXXXFDXXLXDXXMPXXXGXXXXXXXRXMXXXXXMIXGVXXXXXXXEXXXXFXXAGXXXXXXKPLXXXKXXXXXXXX

SEQ ID NO: 245 - protein, 98 aa, Artificial Sequence
  consensus sequence
  VARIANT 1: Xaa = Asn, or Thr
  VARIANT 2: Xaa = Val, or Ala
  VARIANT 4, 22, 72, 77: Xaa = Ile, or Val
  VARIANT 8: Xaa = Asp, or Asn
  VARIANT 9: Xaa = Pro, or Ile
  VARIANT 10: Xaa = Leu, or Val
  VARIANT 11: Xaa = Asn, or Ile
  VARIANT 13: Xaa = Arg, or Lys
  VARIANT 14, 18-19, 38: Xaa = Leu, or Ile
  VARIANT 16: Xaa = Glu, or Gln
  VARIANT 17: Xaa = Met, Ile, or Asn
  VARIANT 20: Xaa = Lys, or Glu
  VARIANT 21, 80-81: Xaa = Thr, or Ser
  VARIANT 24: Xaa = Gly, or Val
  VARIANT 25: Xaa = Ile, or Lys
  VARIANT 26: Xaa = Ser, or Asn
  VARIANT 28: Xaa = Thr, or Gly
  VARIANT 29: Xaa = Ala, or Val
  VARIANT 30: Xaa = Lys, or Glu
  VARIANT 33: Xaa = Glu, or Gln
  VARIANT 37: Xaa = Ile, Asn, or Asp
  VARIANT 40: Xaa = Arg, or Cys
  VARIANT 41: Xaa = Asp, or His
  VARIANT 43: Xaa = Glu, Asn, or Gln
  VARIANT 44: Xaa = Ala, or Ile
  VARIANT 53: Xaa = Lys, or Met
  VARIANT 54: Xaa = Glu, or Asp
  VARIANT 57: Xaa = Glu, or Ile
  VARIANT 58: Xaa = Arg, or Met
  VARIANT 59: Xaa = Asp, or Asn
  VARIANT 61: Xaa = Val, Leu, or Ile
  VARIANT 62, 69: Xaa = Ser, or Glu
  VARIANT 63: Xaa = Thr, or Ala
  VARIANT 66: Xaa = Lys, or Glu
  VARIANT 71: Xaa = Lys, or Gly
  VARIANT 73: Xaa = Thr, or Gly
  VARIANT 82: Xaa = Leu, or Arg
  VARIANT 83: Xaa = Ala, or Cys
  VARIANT 84: Xaa = Asp, or Thr
  VARIANT 85: Xaa = Gln, Asn, or Glu
  VARIANT 86: Xaa = Glu, or Ala
  VARIANT 88: Xaa = Glu, or Ile
XXLXVDDXXXXRXXHXXXXXXXGXXXQXXXNGXEAVXXHXXGXXSFDLILMDXXMPXXXGXXXTKXLRXMXXXSMIXGVXXXXXXXEXRKAFMEAGLN

SEQ ID NO: 246 - protein, 117 aa, Artificial Sequence
  consensus sequence
  VARIANT 1: Xaa = Asn, or Thr
  VARIANT 2: Xaa = Val, or Ala
  VARIANT 4, 10, 14, 18-19, 22, 38, 61, 72, 77, 110, 113-114,117: Xaa = Ile, Leu, Val, or Met
  VARIANT 8: Xaa = Asp, or Asn
  VARIANT 9: Xaa = Pro, or Ile
  VARIANT 11: Xaa = Asn, or Ile
  VARIANT 13: Xaa = His, Lys, or Arg
  VARIANT 16: Xaa = Glu, or Gln
  VARIANT 17, 37, 43, 45, 85, 106, 111, 115-116: Xaa = any amino acid
  VARIANT 20: Xaa = Lys, or Glu
  VARIANT 21, 28, 63, 73, 80-81, 91: Xaa = Thr, Gly, or Ala
  VARIANT 24: Xaa = Gly, or Val
  VARIANT 25: Xaa = Ile, or Lys
  VARIANT 26: Xaa = Ser, or Asn
  VARIANT 29: Xaa = Ala, or Val
  VARIANT 30: Xaa = Lys, or Glu
  VARIANT 33: Xaa = Glu, or Gln
  VARIANT 40: Xaa = Arg, or Cys
  VARIANT 41: Xaa = Asp, or His
  VARIANT 44: Xaa = Ala, or Ile
  VARIANT 53: Xaa = Lys, or Met
  VARIANT 54: Xaa = Glu, or Asp
  VARIANT 57: Xaa = Glu, or Ile
  VARIANT 58: Xaa = Arg, or Met
  VARIANT 59: Xaa = Asp, or Asn
  VARIANT 62: Xaa = Ser, or Glu
  VARIANT 66: Xaa = Lys, or Glu
  VARIANT 69: Xaa = Glu, or Ser
  VARIANT 71: Xaa = Lys, or Gly
  VARIANT 82: Xaa = Leu, or Arg
  VARIANT 83: Xaa = Ala, or Cys
  VARIANT 84: Xaa = Asp, or Thr
  VARIANT 86: Xaa = Glu, or Ala
  VARIANT 88: Xaa = Glu, or Ile
  VARIANT 99: Xaa = His, or Asp
  VARIANT 100: Xaa = Cys, or Tyr
  VARIANT 101: Xaa = Leu, or His
  VARIANT 102: Xaa = Glu, or Ala
  VARIANT 107: Xaa = Lys, or Asn
  VARIANT 112: Xaa = Pro, or Ser
XXLXVDDXXXXRXXHXXXXXXXGXXXQXXXNGXEAVXXHXXGXXXFDLILMDXXMPXXXGXXXTKXLRXMXXXSMIXGVXXXXXXXEXRKXFMEAGLNXXXXKPLXXAKXXXXXXXX

SEQ ID NO: 247 - protein, 204 aa, Artificial Sequence
  consensus sequence
  VARIANT 6, 53, 59, 130: Xaa = Tyr, or Phe
  VARIANT 13: Xaa = Lys, or Arg
  VARIANT 22: Xaa = Leu, or Val
  VARIANT 35: Xaa = Ser, or Ala
  VARIANT 39: Xaa = Leu, or Ile
  VARIANT 40: Xaa = Val, or Thr
  VARIANT 47: Xaa = Lys, or Arg
  VARIANT 61, 64, 89, 132, 142: Xaa = Val, or Ile
  VARIANT 85: Xaa = Thr, or Lys
  VARIANT 86: Xaa = Asn, or His
  VARIANT 97: Xaa = Ser, or Asn
  VARIANT 109: Xaa = Lys, or Arg
  VARIANT 116, 121: Xaa = Val, or Leu
  VARIANT 137: Xaa = Pro, or Val
  VARIANT 140: Xaa = Asn, Ser, or Thr
  VARIANT 151: Xaa = Ile, or Leu
  VARIANT 153: Xaa = Asn, or Lys
  VARIANT 167: Xaa = Glu, or Ala
  VARIANT 171: Xaa = Asn, Phe, or Tyr
  VARIANT 180: Xaa = Asn, Arg, or Thr
  VARIANT 181: Xaa = Asn, or His
  VARIANT 184: Xaa = Asn, or Ala
  VARIANT 194: Xaa = Lys, or Arg
  VARIANT 196: Xaa = Asn, or Gln
  VARIANT 197: Xaa = Ser, or Thr
  VARIANT 198: Xaa = Leu, or Val
MGAYKXVSELWRXKQSDVMRFXQRVRCWEYRQQPXIVRXXRPTRPDXARRLGXKAKQGXVXYRXRVRRGGRKRPVPKGIVYGKPXXQGXTQLKFQRXKRSVAEERAGRXLGGLRVXNSYWXNEDSTYKYXEXILVDXAHXAXRNDPRINWXCXPVHKHRELRGLTSXGKKXRGLRGKGHXXHKXRPSRRATWKXNXXXSLRRYR

SEQ ID NO: 248 - protein, 204 aa, Artificial Sequence; identical to SEQ ID NO: 247
  consensus sequence
  VARIANT 6, 53, 59, 130, 132: Xaa = Phe, Tyr, or Trp
  VARIANT 13, 47, 109, 194: Xaa = His, Lys, or Arg
  VARIANT 22, 39, 61, 64, 89, 116, 121, 142, 151, 198: Xaa = Ile, Leu, Val, or Met
  VARIANT 35, 197: Xaa = Thr, Gly, or Ala
  VARIANT 40: Xaa = Val, or Thr
  VARIANT 85: Xaa = Thr, or Lys
  VARIANT 86: Xaa = Asn, or His
  VARIANT 97: Xaa = Ser, or Asn
  VARIANT 137: Xaa = Pro, or Val
  VARIANT 140, 171, 180: Xaa = any amino acid
  VARIANT 153: Xaa = Asn, or Lys
  VARIANT 167: Xaa = Glu, or Ala
  VARIANT 181: Xaa = Asn, or His
  VARIANT 184: Xaa = Asn, or Ala
  VARIANT 196: Xaa = Asn, or Gln

SEQ ID NO: 249 - protein, 498 aa, Artificial Sequence
  consensus sequence
  VARIANT 3: Xaa = Leu, or Val
  VARIANT 9: Xaa = Ser, Thr, or Ala
  VARIANT 11: Xaa = Ile, or Leu
  VARIANT 12: Xaa = Ala, or Gly
  VARIANT 13: Xaa = Val, or Leu
  VARIANT 15: Xaa = Val, Leu, Ala, or Ile
  VARIANT 16: Xaa = Ala, or Gly
  VARIANT 17: Xaa = Val, Ala, or Ile
  VARIANT 18: Xaa = Ile, Val, or Ala
  VARIANT 19: Xaa = Leu, Val, or Ala
  VARIANT 20: Xaa = Ala, or Ser
  VARIANT 21: Xaa = Thr, Ile, or Gly
  VARIANT 22: Xaa = Val, Ala, or Asn
  VARIANT 23: Xaa = Ile, or Val
  VARIANT 24: Xaa = Ser, or Ala
  VARIANT 25: Xaa = Lys, or Thr
  VARIANT 27: Xaa = Arg, or Thr
  VARIANT 29: Xaa = Lys, Arg, Ala, or Gly
  VARIANT 30: Xaa = Lys, Arg, or Ala
  VARIANT 31: Xaa = Leu, Phe, or Asn
  VARIANT 32: Xaa = Lys, Arg, Asp, or Asn
  VARIANT 33: Xaa = Leu, or Ala
  VARIANT 38: Xaa = Ile, Leu, Ser, or Pro
  VARIANT 39: Xaa = Pro, Gly, or Ala
  VARIANT 40: Xaa = Ile, Val, or Ala
  VARIANT 42: Xaa = Ile, or Val
  VARIANT 43: Xaa = Phe, or Val
  VARIANT 51: Xaa = Asp, or Asn
  VARIANT 57: Xaa = Asn, or Phe
  VARIANT 59: Xaa = Val, Thr, Met, or Ala
  VARIANT 60: Xaa = Asp, Gly, Arg, Tyr, or Leu
  VARIANT 61: Xaa = Ala, or Ser
  VARIANT 62: Xaa = Lys, or Ala
  VARIANT 63: Xaa = Lys, or Arg
  VARIANT 64: Xaa = Phe, or Tyr
  VARIANT 66: Xaa = Asp, Glu, or Pro
  VARIANT 67: Xaa = Leu, Ile, or Val
  VARIANT 69: Xaa = Leu, or Arg
  VARIANT 72: Xaa = Met, or Leu
  VARIANT 74: Xaa = Gln, or Val
  VARIANT 82: Xaa = Ser, or Asp
  VARIANT 84: Xaa = Asp, Glu, Arg, or Asn
  VARIANT 86: Xaa = Thr, or Ala
  VARIANT 87: Xaa = Lys, or Thr
  VARIANT 91: Xaa = Leu, or His
  VARIANT 101: Xaa = Thr, or Pro
  VARIANT 111: Xaa = Gly, or Ala
  VARIANT 112: Xaa = Lys, or Asn
  VARIANT 114: Xaa = Gln, or Ala
  VARIANT 119: Xaa = Thr, Val, or Glu
  VARIANT 122: Xaa = Glu, or Asp
  VARIANT 126: Xaa = Lys, or Arg
  VARIANT 130: Xaa = Ile, or Val
  VARIANT 133: Xaa = Val, or Leu
  VARIANT 138: Xaa = Asn, or Ala
  VARIANT 139: Xaa = Lys, or Arg
  VARIANT 142: Xaa = Gln, or Ala
  VARIANT 143: Xaa = Gln, or Arg
  VARIANT 144: Xaa = Asn, or Tyr
  VARIANT 146: Xaa = Glu, His, Val, or Gly
  VARIANT 147: Xaa = Gly, or Met
  VARIANT 150: Xaa = Phe, Ser, Glu, or Ala
  VARIANT 152: Xaa = Ala, or Met
  VARIANT 153: Xaa = Ala, Arg, or Asp
  VARIANT 154: Xaa = Ser, Ala, or Leu
  VARIANT 155: Xaa = Val, or Ala
  VARIANT 157: Xaa = Glu, or Ser
  VARIANT 159: Xaa = Val, or Leu
  VARIANT 160: Xaa = Lys, or Ala
  VARIANT 161: Xaa = Lys, Ala, or Ser
  VARIANT 162: Xaa = Asn, Asp, or Ala
  VARIANT 163: Xaa = Pro, or Ala
  VARIANT 164: Xaa = Asp, Ala, or Gln
  VARIANT 165: Xaa = Ser, Ala, or Arg
  VARIANT 167: Xaa = Thr, Val, or Ala
  VARIANT 168: Xaa = Lys, Ser, or Ala
  VARIANT 170: Xaa = Ile, Thr, Val, or Leu
  VARIANT 172: Xaa = Leu, Ile, or Val
  VARIANT 174: Xaa = Lys, or Arg
  VARIANT 180: Xaa = Met, or Leu
  VARIANT 183: Xaa = Asn, Asp, or Ile
  VARIANT 185: Xaa = Phe, or Tyr
  VARIANT 186: Xaa = Arg, or Gly
  VARIANT 187: Xaa = Ile, or Met
  VARIANT 191: Xaa = Arg, or Ala
  VARIANT 194: Xaa = Glu, or Gly
  VARIANT 196: Xaa = Glu, or Val
  VARIANT 197: Xaa = Asp, Glu, or Ala
  VARIANT 200: Xaa = Leu, Ile, or Met
  VARIANT 202: Xaa = Leu, Gln, Asn, or Val
  VARIANT 203: Xaa = Arg, Gln, or Glu
  VARIANT 204: Xaa = Leu, or Ala
  VARIANT 205: Xaa = Lys, Arg, or Thr
  VARIANT 206: Xaa = Ala, or Arg
  VARIANT 207: Xaa = Leu, or Phe
  VARIANT 209: Xaa = Gly, Ala, or Ser
  VARIANT 213: Xaa = Arg, or Ile
  VARIANT 215: Xaa = Ala, or Ser
  VARIANT 219: Xaa = Glu, or Asp
  VARIANT 228: Xaa = Ile, or Val
  VARIANT 234: Xaa = Arg, or Lys
  VARIANT 235: Xaa = Gly, or Arg
  VARIANT 238: Xaa = Lys, Asn, Ala, Ile, or Arg
  VARIANT 240: Xaa = Gln, Lys, or Thr
  VARIANT 241: Xaa = Asp, Glu, or Asn
  VARIANT 242: Xaa = Val, or Leu
  VARIANT 243: Xaa = Lys, or Gln
  VARIANT 244: Xaa = Asp, Glu, Thr, or Ala
  VARIANT 245: Xaa = Arg, Thr, or Lys
  VARIANT 247: Xaa = Ile, Leu, or Met
  VARIANT 248: Xaa = Ala, or Lys
  VARIANT 249: Xaa = Leu, Val, or Phe
  VARIANT 251: Xaa = Lys, Glu, or Asn
  VARIANT 252: Xaa = Lys, Asp, or Ser
  VARIANT 253: Xaa = Tyr, His, or Asn
  VARIANT 254: Xaa = Phe, or Tyr
  VARIANT 256: Xaa = Asp, Gln, or Glu
  VARIANT 257: Xaa = Glu, Gln, or Lys
  VARIANT 259: Xaa = Lys, or Arg
  VARIANT 260: Xaa = Gln, Lys, or Glu
  VARIANT 261: Xaa = Ile, Leu, or Val
  VARIANT 262: Xaa = Ala, Gly, or Met
  VARIANT 263: Xaa = Ser, Ala, or Asp
  VARIANT 264: Xaa = Ser, Thr, Leu, or Ala
  VARIANT 265: Xaa = Lys, or Glu
  VARIANT 266: Xaa = Pro, Ser, or Lys
  VARIANT 267: Xaa = Thr, or Gly
  VARIANT 268: Xaa = Gly, Asn, or Asp
  VARIANT 269: Xaa = Ser, Asn, Glu, or Lys
  VARIANT 270: Xaa = Glu, Asn, or Gly
  VARIANT 271: Xaa = Gly, Asn, or Lys
  VARIANT 272: Xaa = Leu, or Ile
  VARIANT 273: Xaa = Lys, or Arg
  VARIANT 276: Xaa = Ile, or Met
  VARIANT 279: Xaa = Ile, or Val
  VARIANT 281: Xaa = Glu, Asp, or Gln
  VARIANT 283: Xaa = Glu, or Gln
  VARIANT 284: Xaa = Gln, Arg, or Lys
  VARIANT 285: Xaa = Lys, or Ser
  VARIANT 289: Xaa = Asn, or Thr
  VARIANT 290: Xaa = Glu, His, or Pro
  VARIANT 291: Xaa = Asp, or Glu
  VARIANT 294: Xaa = Leu, or Ile
  VARIANT 297: Xaa = Val, or Glu
  VARIANT 314: Xaa = Gly, or Ala
  VARIANT 315: Xaa = Ile, or Leu
  VARIANT 318: Xaa = Leu, or Val
  VARIANT 323: Xaa = Glu, or Ala
  VARIANT 324: Xaa = Ile, or Val
  VARIANT 326: Xaa = Ser, Gln, or Arg
  VARIANT 328: Xaa = Leu, or Val
  VARIANT 330: Xaa = Asn, Asp, or Glu
  VARIANT 332: Xaa = Leu, or Ile
  VARIANT 333: Xaa = Asp, Val, or Lys
  VARIANT 334: Xaa = Thr, Arg, or Ala
  VARIANT 336: Xaa = Leu, or Val
  VARIANT 337: Xaa = Gly, or Ala
  VARIANT 338: Xaa = Pro, Ala, or Asp
  VARIANT 339: Xaa = Gly, or His
  VARIANT 340: Xaa = Val, His, or Glu
  VARIANT 341: Xaa = Gln, Ala, or Pro
  VARIANT 342: Xaa = Val, or Ile
  VARIANT 345: Xaa = Pro, or Ser
  VARIANT 346: Xaa = Asp, or Thr
  VARIANT 347: Xaa = Leu, or Ile
  VARIANT 348: Xaa = His, Gln, or Glu
  VARIANT 349: Xaa = Lys, or Arg
  VARIANT 355: Xaa = Ala, or Ser
  VARIANT 356: Xaa = Val, or Ile
  VARIANT 363: Xaa = Arg, or His
  VARIANT 364: Xaa = Met, or Ser
  VARIANT 365: Xaa = Ala, or Pro
  VARIANT 376: Xaa = His, Ser, or Glu
  VARIANT 377: Xaa = Asp, or Glu
  VARIANT 381: Xaa = Ala, or Gly
  VARIANT 384: Xaa = Asp, or Thr
  VARIANT 387: Xaa = Ala, or Lys
  VARIANT 388: Xaa = Glu, or Gly
  VARIANT 391: Xaa = Ile, or Val
  VARIANT 392: Xaa = Leu, or Val
  VARIANT 397: Xaa = Trp, or Phe
  VARIANT 401: Xaa = Asn, or Asp
  VARIANT 403: Xaa = Asn, Ala, Lys, or Glu
  VARIANT 404: Xaa = Ser, His, Arg, or Leu
  VARIANT 406: Xaa = Lys, Val, or Asp
  VARIANT 407: Xaa = Lys, or Arg
  VARIANT 408: Xaa = Pro, or Ala
  VARIANT 409: Xaa = Glu, or Asp
  VARIANT 415: Xaa = Arg, or Phe
  VARIANT 416: Xaa = Phe, or Leu
  VARIANT 417: Xaa = Glu, or Gly
  VARIANT 420: Xaa = Ser, or Lys
  VARIANT 421: Xaa = His, Leu, Ala, or Ser
  VARIANT 423: Xaa = Glu, or Asp
  VARIANT 425: Xaa = Asn, His, or Thr
  VARIANT 426: Xaa = Gly, or Val
  VARIANT 427: Xaa = Asn, or Gly
  VARIANT 431: Xaa = Tyr, or Phe
  VARIANT 432: Xaa = Val, or Leu
  VARIANT 451: Xaa = Leu, or Ile
  VARIANT 452: Xaa = Gly, or Ala
  VARIANT 453: Xaa = Ile, or Leu
  VARIANT 454: Xaa = Thr, or Ile
  VARIANT 455: Xaa = Ile, Leu, or Val
  VARIANT 457: Xaa = Arg, or Lys
  VARIANT 458: Xaa = Met, or Leu
  VARIANT 460: Xaa = Gln, or Arg
  VARIANT 461: Xaa = Asn, or Ser
  VARIANT 463: Xaa = Glu, or Gln
  VARIANT 464: Xaa = Leu, or Met
  VARIANT 465: Xaa = Leu, or Val
  VARIANT 470: Xaa = Gln, or Val
  VARIANT 471: Xaa = Ser, Asp, or Glu
  VARIANT 472: Xaa = Lys, or Gln
  VARIANT 473: Xaa = Val, Ile, or Leu
  VARIANT 475: Xaa = Thr, or Val
  VARIANT 476: Xaa = Ser, or Thr
  VARIANT 479: Xaa = Gly, or Pro
  VARIANT 483: Xaa = Ser, or Thr
  VARIANT 484: Xaa = Leu, or Asn
  VARIANT 485: Xaa = His, or Gln
  VARIANT 487: Xaa = Leu, or Ala
  VARIANT 488: Xaa = Asn, or Lys
  VARIANT 490: Xaa = Ser, or Ala
  VARIANT 491: Xaa = Ile, Thr, or Val
  VARIANT 493: Xaa = Val, or Ala
  VARIANT 494: Xaa = Met, Ala, Cys, or Phe
  VARIANT 495: Xaa = Lys, or His
  VARIANT 498: Xaa = Asn, or Ser
MDXLLLEKXLXXXFXXXXXXXXXXXLXGXXXXXPPGPXXXPXXGNWLQVGXDLNHRXLXXXXXXGXXFXLRXGXRNLVVVSXPXLXXEVLXTQGVEFGSRXRNVVFDIFTXXGXDMVFXYGXHWRXMRRXMTXPFFTXXVVXXXRXXWEXEXXXXVXDXXXXXXXAXXGXVXRXRLQLMXYNXMXXXMFDXRFXSXXDPXFXXXXXXNXERSXLXQSFXYNYGDFIPXLRPFLXXYLXCXXXXXXRXXXFXXXXVXXRXXXXXXXXXXXXXXXCAXDHXLXAXXXGEIXXXNVXYIXNINVAAIETTLWSIEWXXAEXVNHPXXQXKXRXEXXXVXXXXXXXTEXXXXXLPYLQXXKETLRLXXXIPLLVPHMNLXXAKLXGYXIPXXSKXXVNAWXLANXPXXWXXXXEFRPEXXXEEXXVXAXXXDFRXXPFGVGRRSCPGIILALPIXXXXXGXXVXXFXXXPPPGXXXXDXXEKXGQFXXXIXXHXXIXXXPRX

SEQ ID NO: 250 - protein, 508 aa, Artificial Sequence
  consensus sequence
  VARIANT 3, 11, 13, 23, 42, 68, 73, 132, 135, 161, 174,182, 189, 202, 230, 245, 250, 276, 280, 283, 298,320, 323, 329, 333, 337, 341, 347, 352, 362,397-398, 442, 461, 463, 465, 468, 474-475, 483: Xaa = Ile, Leu, Val, or Met
  VARIANT 9, 12, 16, 20, 24, 62, 87, 112, 211, 217, 270,319, 342, 360, 387, 462, 486, 493, 500: Xaa = Thr, Gly, or Ala
  VARIANT 15, 17-19, 21-22, 25-27, 29-32, 38-40, 59-60, 67,85, 148, 152, 155-156, 163-164, 166-167, 169-170,172, 185, 199, 204-205, 207, 240, 243-244, 247-248,252, 254-256, 259-260, 263-269, 271-275, 285, 288,294, 331, 335, 338-339, 343, 345-346, 353, 382,409-410, 412, 428, 432, 435-437, 481, 501, 504: Xaa = any amino acid
  VARIANT 33: Xaa = Leu, or Ala
  VARIANT 43: Xaa = Phe, or Val
  VARIANT 51: Xaa = Asp, or Asn
  VARIANT 57: Xaa = Asn, or Phe
  VARIANT 61: Xaa = Tyr, or Leu
  VARIANT 63: Xaa = Lys, or Ala
  VARIANT 64, 128, 141, 176, 236, 262, 277, 354, 369, 413,467, 505: Xaa = His, Lys, or Arg
  VARIANT 65, 187, 257, 403, 441: Xaa = Phe, Tyr, or Trp
  VARIANT 70: Xaa = Leu, or Arg
  VARIANT 75: Xaa = Gln, or Val
  VARIANT 83: Xaa = Ser, or Asp
  VARIANT 88: Xaa = Lys, or Thr
  VARIANT 92: Xaa = Leu, or His
  VARIANT 102: Xaa = Thr, or Pro
  VARIANT 113: Xaa = Lys, or Asn
  VARIANT 115: Xaa = Gln, or Ala
  VARIANT 121: Xaa = Val, or Glu
  VARIANT 124, 221, 295, 383, 415, 430: Xaa = Glu, or Asp
  VARIANT 140: Xaa = Asn, or Ala
  VARIANT 144: Xaa = Gln, or Ala
  VARIANT 145: Xaa = Gln, or Arg
  VARIANT 146: Xaa = Asn, or Tyr
  VARIANT 149: Xaa = Gly, or Met
  VARIANT 154: Xaa = Ala, or Met
  VARIANT 157: Xaa = Val, or Ala
  VARIANT 159: Xaa = Glu, or Ser
  VARIANT 162: Xaa = Lys, or Ala
  VARIANT 165: Xaa = Pro, or Ala
  VARIANT 188: Xaa = Arg, or Gly
  VARIANT 193: Xaa = Arg, or Ala
  VARIANT 196: Xaa = Glu, or Gly
  VARIANT 198: Xaa = Glu, or Val
  VARIANT 206: Xaa = Leu, or Ala
  VARIANT 208: Xaa = Ala, or Arg
  VARIANT 209: Xaa = Leu, or Phe
  VARIANT 215: Xaa = Arg, or Ile
  VARIANT 237: Xaa = Gly, or Arg
  VARIANT 241: Xaa = Ile, or Arg
  VARIANT 246: Xaa = Lys, or Gln
  VARIANT 251: Xaa = Ala, or Lys
  VARIANT 287: Xaa = Glu, or Gln
  VARIANT 289: Xaa = Lys, or Ser
  VARIANT 293: Xaa = Asn, or Thr
  VARIANT 328: Xaa = Glu, or Ala
  VARIANT 344: Xaa = Gly, or His
  VARIANT 350: Xaa = Pro, or Ser
  VARIANT 351: Xaa = Asp, or Thr
  VARIANT 370: Xaa = Met, or Ser
  VARIANT 371: Xaa = Ala, or Pro
  VARIANT 390: Xaa = Asp, or Thr
  VARIANT 393: Xaa = Ala, or Lys
  VARIANT 394: Xaa = Glu, or Gly
  VARIANT 407: Xaa = Asn, or Asp
  VARIANT 414: Xaa = Pro, or Ala
  VARIANT 423: Xaa = Phe, or Leu
  VARIANT 424: Xaa = Glu, or Gly
  VARIANT 427: Xaa = Ser, or Lys
  VARIANT 433: Xaa = Gly, or Val
  VARIANT 434: Xaa = Asn, or Gly
  VARIANT 464: Xaa = Thr, or Ile
  VARIANT 470: Xaa = Gln, or Arg
  VARIANT 471: Xaa = Asn, or Ser
  VARIANT 473: Xaa = Glu, or Gln
  VARIANT 480: Xaa = Gln, or Val
  VARIANT 482: Xaa = Lys, or Gln
  VARIANT 485: Xaa = Thr, or Val
  VARIANT 489: Xaa = Gly, or Pro
  VARIANT 494: Xaa = Leu, or Asn
  VARIANT 495: Xaa = His, or Gln
  VARIANT 497: Xaa = Leu, or Ala
  VARIANT 498: Xaa = Asn, or Lys
  VARIANT 503: Xaa = Val, or Ala
  VARIANT 508: Xaa = Asn, or Ser
MDXLLLEKXLXXXFXXXXXXXXXXXXXGXXXXXPPGPXXXPXXGNWLQVGXDLNHRXLXXXXXXXGXXFXLRXGXRNLVVVSXPXLXXEVLXTQGVEFGSRXRNVVFDIFTXXGXDMVFTXYGXHWRXMRRXMTXPFFTXXVVXXXRXXWEXEXXXXVXDXXXXXXXAXXGXVXRXRLQLMXYNXMXXXMFDXRFXSXXDPXFXXXXXXNXERSXLXQSFXYNYGDFIPXLRPFLXXYLXXCXXXXXXRXXXFXXXXVXXRXXXXXXXXXXXXXXXXCAXDHXLXAXXXGEIXXXNVXYIVENINVAAIETTLWSIEWXXAEXVNHPXXQXKXRXEXXXVXXXXXXXTEXXXXXLPYLQXVXKETLRLXXXIPLLVPHMNLXXAKLXGYXIPXXSKXXVNAWXLANXPXXWXXXXEFRPERFXXEEXXVXAXXXXXXDFRXXPFGVGRRSCPGIILALPIXXXXXGXXVXXFXXXPPPGXXXXDXXEKXGQFXXXIXXHXXIXXXPRX

SEQ ID NO: 251 - protein, 230 aa, Artificial Sequence
  consensus sequence
  VARIANT 5: Xaa = Lys, or Arg
  VARIANT 6: Xaa = Ile, or Ser
  VARIANT 14: Xaa = Ser, Thr, Asn, Lys, or Pro
  VARIANT 16: Xaa = Asn, Ser, or Gln
  VARIANT 19: Xaa = Val, or Ser
  VARIANT 22: Xaa = Cys, or Tyr
  VARIANT 26: Xaa = Asn, or Asp
  VARIANT 29: Xaa = Leu, or Phe
  VARIANT 33: Xaa = Tyr, or Arg
  VARIANT 36: Xaa = Ser, or Ala
  VARIANT 37: Xaa = Val, or Ile
  VARIANT 41: Xaa = Ala, or Val
  VARIANT 42: Xaa = Glu, or Asp
  VARIANT 43: Xaa = Val, Ile, or Leu
  VARIANT 44: Xaa = Ala, or Leu
  VARIANT 46: Xaa = Ile, Val, or Leu
  VARIANT 47: Xaa = Val, or Leu
  VARIANT 50: Xaa = Thr, or Ser
  VARIANT 51: Xaa = Arg, or Ser
  VARIANT 53: Xaa = Arg, or Lys
  VARIANT 56: Xaa = Glu, or Gln
  VARIANT 57, 89, 90, 201: Xaa = Tyr, or Phe
  VARIANT 58: Xaa = Ala, or Ser
  VARIANT 59, 61: Xaa = Asn, or Ser
  VARIANT 62: Xaa = Ile, Val, or Thr
  VARIANT 63: Xaa = Arg, or Lys
  VARIANT 64: Xaa = Ser, or Ala
  VARIANT 66: Xaa = Ile, or Val
  VARIANT 67: Xaa = Glu, or Asp
  VARIANT 73: Xaa = Cys, Ser, Ala, or His
  VARIANT 74: Xaa = Ser, Ala, Cys, or Thr
  VARIANT 75: Xaa = Asp, Ser, or Gly
  VARIANT 76: Xaa = Ser, His, Asn, or Thr
  VARIANT 77: Xaa = Thr, or Ser
  VARIANT 78: Xaa = Asn, Ser, or Gly
  VARIANT 79: Xaa = Thr, Ala, or Gly
  VARIANT 80: Xaa = Ser, His, Ala, Val, or Pro
  VARIANT 81: Xaa = Thr, Ser, or Pro
  VARIANT 82: Xaa = Val, Thr, or Leu
  VARIANT 83: Xaa = Gln, Thr, Ile, or Leu
  VARIANT 84: Xaa = Glu, or Asp
  VARIANT 85: Xaa = Ile, Val, or His
  VARIANT 87: Xaa = Ala, or Ser
  VARIANT 88: Xaa = Ala, or Gln
  VARIANT 94: Xaa = Ser, or Ala
  VARIANT 99: Xaa = Gln, His, or Asn
  VARIANT 103: Xaa = Thr, or Met
  VARIANT 104: Xaa = Ile, or Leu
  VARIANT 106: Xaa = Asn, or Ser
  VARIANT 107: Xaa = Ser, or Thr
  VARIANT 109: Xaa = Arg, or Lys
  VARIANT 110: Xaa = Asn, or His
  VARIANT 112: Xaa = Met, or Val
  VARIANT 114: Xaa = Asp, or Glu
  VARIANT 115: Xaa = Ser, or Ala
  VARIANT 116: Xaa = Leu, Thr, or Val
  VARIANT 117: Xaa = Ser, or Gly
  VARIANT 118: Xaa = Ser, Thr, Ala, or Asn
  VARIANT 119: Xaa = Leu, or Met
  VARIANT 120: Xaa = Ser, or Thr
  VARIANT 121: Xaa = Val, Ala, or Leu
  VARIANT 126: Xaa = Gln, or Gly
  VARIANT 127: Xaa = Val, or Leu
  VARIANT 129: Xaa = Asn, or Ser
  VARIANT 133: Xaa = Lys, or Arg
  VARIANT 134: Xaa = Ala, or Gly
  VARIANT 136: Xaa = Ser, Thr, or Gly
  VARIANT 145: Xaa = Leu, or Met
  VARIANT 148: Xaa = Val, or Ala
  VARIANT 152: Xaa = Asn, or Tyr
  VARIANT 153: Xaa = Ala, Phe, or Met
  VARIANT 158: Xaa = Ile, or Ala
  VARIANT 159: Xaa = Glu, or Asp
  VARIANT 161: Xaa = Asp, Glu, or His
  VARIANT 165: Xaa = Ile, Leu, or Met
  VARIANT 166: Xaa = Tyr, Cys, or Phe
  VARIANT 169: Xaa = Thr, or Ala
  VARIANT 171: Xaa = Val, or Ile
  VARIANT 172: Xaa = Ala, or Thr
  VARIANT 173: Xaa = Glu, or Asp
  VARIANT 174: Xaa = Val, or Ala
  VARIANT 177: Xaa = Tyr, or Ile
  VARIANT 180: Xaa = His, or Val
  VARIANT 181: Xaa = His, or Asn
  VARIANT 188, 220, 222: Xaa = Ser, or Pro
  VARIANT 190: Xaa = Ile, or Leu
  VARIANT 194: Xaa = Glu, or Gln
  VARIANT 203: Xaa = Ala, or Asn
  VARIANT 204: Xaa = His, or Pro
  VARIANT 205: Xaa = Ser, or Asn
  VARIANT 206: Xaa = Ile, or Met
  VARIANT 207: Xaa = Met, or Leu
  VARIANT 208: Xaa = Thr, or Glu
  VARIANT 209: Xaa = Ala, or Gly
  VARIANT 211: Xaa = Ser, or Thr
  VARIANT 218: Xaa = Ser, or Val
  VARIANT 221: Xaa = Asp, or His
MGRGXXEIKRIENXTXRQXTFXKRRXGLXKKAXELXXLCDXXXXLXXFSXXGXLYXXXXNXXXXTXXRYKKAXXXXXXXXXXXXXNXXXXQQEXAKLRXQIQXXQXXNXXLXGXXXXXXXXKELKXXEXRLEXXIXRIRSKKHEXLLXEIEXXQKREXXLXNENXXLRXKXXXXERXQQXXHQMVSGXEXNAIXALASRNXFXXXXXXXGXGSGNGGXYXXXDKKILHLG

SEQ ID NO: 252 - protein, 234 aa, Artificial Sequence
  consensus sequence
  VARIANT 5, 53, 64, 113, 137: Xaa = His, Lys, or Arg
  VARIANT 6: Xaa = Ile, or Ser
  VARIANT 14, 16, 60, 63, 74-79, 81, 83-86, 88, 91, 103,120, 122, 125, 157, 165, 170, 186-187, 216-221: Xaa = any amino acid
  VARIANT 19: Xaa = Val, or Ser
  VARIANT 22: Xaa = Cys, or Tyr
  VARIANT 26: Xaa = Asn, or Asp
  VARIANT 29: Xaa = Leu, or Phe
  VARIANT 33: Xaa = Tyr, or Arg
  VARIANT 36, 50, 58, 65, 80, 82, 90, 98, 111, 119, 121,124, 138, 140, 173, 176, 213, 215: Xaa = Thr, Gly, or Ala
  VARIANT 37, 43, 46-47, 67, 108, 116, 123, 131, 149, 169,175, 194, 210-211: Xaa = Ile, Leu, Val, or Met
  VARIANT 41: Xaa = Ala, or Val
  VARIANT 42, 68, 87, 118, 163, 177: Xaa = Glu, or Asp
  VARIANT 44: Xaa = Ala, or Leu
  VARIANT 51: Xaa = Arg, or Ser
  VARIANT 56: Xaa = Glu, or Gln
  VARIANT 57, 93-94, 205: Xaa = Phe, Tyr, or Trp
  VARIANT 59, 62: Xaa = Asn, or Ser
  VARIANT 92: Xaa = Ala, or Gln
  VARIANT 107: Xaa = Thr, or Met
  VARIANT 110: Xaa = Asn, or Ser
  VARIANT 114: Xaa = Asn, or His
  VARIANT 130: Xaa = Gln, or Gly
  VARIANT 133: Xaa = Asn, or Ser
  VARIANT 152: Xaa = Val, or Ala
  VARIANT 156: Xaa = Asn, or Tyr
  VARIANT 162: Xaa = Ile, or Ala
  VARIANT 178: Xaa = Val, or Ala
  VARIANT 181: Xaa = Tyr, or Ile
  VARIANT 184: Xaa = His, or Val
  VARIANT 185: Xaa = His, or Asn
  VARIANT 192: Xaa = Ser, or Pro
  VARIANT 198: Xaa = Glu, or Gln
  VARIANT 207: Xaa = Ala, or Asn
  VARIANT 208: Xaa = His, or Pro
  VARIANT 209: Xaa = Ser, or Asn
  VARIANT 212: Xaa = Thr, or Glu
  VARIANT 222: Xaa = Ser, or Val
  VARIANT 224: Xaa = Ser, or Pro
  VARIANT 225: Xaa = Asp, or His
  VARIANT 226: Xaa = Pro, or Ser
MGRGXXEIKRIENXTXRQXTFXKRRXGLXKKAXELXXLCDXXXXLXXFSXXGXLYXXXXXNXXXXTXXRYKKAXXXXXXXXXXXXXXXNXXXXXQQEXAKLRXQIQXXQXXNXXLXGXXXXXXXXKELKXXEXRLEXXIXRIRSKKHEXLLXEIEXXQKREXXLXNENXXLRXKXXXXERXQQXXXXMVSGXEXNAIXALASRNXFXXXXXXXGXXXXXXXXYXXXDKKILHLG

SEQ ID NO: 253 - protein, 441 aa, Artificial Sequence
  consensus sequence
  VARIANT 12: Xaa = Val, or Ile
  VARIANT 14: Xaa = Leu, or Val
  VARIANT 17: Xaa = His, or Tyr
  VARIANT 18: Xaa = Thr, or Ser
  VARIANT 26: Xaa = Glu, or Asp
  VARIANT 28: Xaa = Ala, or Thr
  VARIANT 37: Xaa = Ile, or Val
  VARIANT 39: Xaa = Ala, or Ser
  VARIANT 40: Xaa = Val, or Ile
  VARIANT 41: Xaa = Asp, or Glu
  VARIANT 42: Xaa = Gly, or Gln
  VARIANT 43: Xaa = Val, or Thr
  VARIANT 45: Xaa = Ala, Gln, or Asp
  VARIANT 46: Xaa = Met, or Thr
  VARIANT 47: Xaa = Asp, or Glu
  VARIANT 50: Xaa = Val, Ala, or Pro
  VARIANT 51: Xaa = Asp, or Lys
  VARIANT 52: Xaa = Ser, Asn, or Pro
  VARIANT 53: Xaa = Thr, Gly, Glu, or Ala
  VARIANT 54: Xaa = Lys, or Glu
  VARIANT 55: Xaa = Thr, Lys, or Glu
  VARIANT 56: Xaa = Asn, or Ala
  VARIANT 57: Xaa = Ser, Asn, or Asp
  VARIANT 58: Xaa = Asn, or Ser
  VARIANT 59: Xaa = Ser, Asn, or Ala
  VARIANT 60: Xaa = Glu, Asn, or Ser
  VARIANT 61: Xaa = Asp, or Val
  VARIANT 62: Xaa = Ser, or Arg
  VARIANT 63: Xaa = Lys, or Asn
  VARIANT 64: Xaa = Thr, Ala, or Asn
  VARIANT 65: Xaa = Glu, Asp, or Lys
  VARIANT 66: Xaa = Ser, or Val
  VARIANT 67: Xaa = Glu, or Asp
  VARIANT 69: Xaa = Glu, Ala, or Asp
  VARIANT 71: Xaa = Gly, or Thr
  VARIANT 74: Xaa = Lys, or Arg
  VARIANT 76: Xaa = Tyr, or Cys
  VARIANT 81: Xaa = Ala, Ser, or Glu
  VARIANT 82: Xaa = Met, or Leu
  VARIANT 83: Xaa = Ser, Gly, Glu, or Asn
  VARIANT 84: Xaa = Tyr, or Phe
  VARIANT 91: Xaa = Val, or Ile
  VARIANT 92: Xaa = Leu, or Ile
  VARIANT 94: Xaa = Pro, or Ser
  VARIANT 95: Xaa = Ile, Phe, or Met
  VARIANT 99: Xaa = Ile, Val, or Thr
  VARIANT 101: Xaa = Ser, Ala, or Thr
  VARIANT 105: Xaa = Leu, or Ile
  VARIANT 108: Xaa = Asn, or Ser
  VARIANT 111: Xaa = Glu, Asp, or Asn
  VARIANT 115: Xaa = Lys, or Arg
  VARIANT 116: Xaa = Ser, Asp, or Arg
  VARIANT 117: Xaa = Cys, or Arg
  VARIANT 119: Xaa = Met, or Leu
  VARIANT 121: Xaa = Asp, or Asn
  VARIANT 123: Xaa = Thr, Lys, or Glu
  VARIANT 129: Xaa = Leu, or Ile
  VARIANT 133: Xaa = Pro, or Ser
  VARIANT 134: Xaa = Leu, Ser, or Thr
  VARIANT 136: Xaa = Thr, or Ser
  VARIANT 137: Xaa = Gln, or Ala
  VARIANT 142: Xaa = Lys, or Arg
  VARIANT 143: Xaa = Ala, or Thr
  VARIANT 144: Xaa = Ala, or Val
  VARIANT 146: Xaa = Leu, or His
  VARIANT 147: Xaa = Met, or Ile
  VARIANT 150: Xaa = Lys, or Asn
  VARIANT 153: Xaa = Val, or Ala
  VARIANT 158: Xaa = Met, or Leu
  VARIANT 162: Xaa = Pro, or Ala
  VARIANT 169: Xaa = Thr, or Ser
  VARIANT 175: Xaa = Leu, or Val
  VARIANT 179: Xaa = Cys, Gly, or Ser
  VARIANT 185: Xaa = Thr, or Val
  VARIANT 186: Xaa = Ile, or Val
  VARIANT 187: Xaa = Ser, or Ala
  VARIANT 188: Xaa = Pro, or Ala
  VARIANT 193: Xaa = Tyr, or Phe
  VARIANT 198: Xaa = Ala, or Ser
  VARIANT 200: Xaa = Val, Ala, or Ser
  VARIANT 201: Xaa = Ser, or Thr
  VARIANT 204: Xaa = Leu, Ile, or Val
  VARIANT 213: Xaa = Leu, or Met
  VARIANT 214: Xaa = Leu, or Met
  VARIANT 222: Xaa = Ile, or Val
  VARIANT 223: Xaa = Lys, Met, or Val
  VARIANT 225: Xaa = Arg, or Lys
  VARIANT 231: Xaa = Lys, or Arg
  VARIANT 232: Xaa = Arg, or Lys
  VARIANT 235: Xaa = Val, or Ile
  VARIANT 236: Xaa = Arg, or Ser
  VARIANT 237: Xaa = Ala, or Pro
  VARIANT 239: Xaa = Glu, or Asp
  VARIANT 240: Xaa = Phe, or Tyr
  VARIANT 241: Xaa = Gln, or Lys
  VARIANT 242: Xaa = Val, Thr, or Ile
  VARIANT 243: Xaa = Glu, or Val
  VARIANT 245: Xaa = Val, or Leu
  VARIANT 246: Xaa = Asp, or Glu
  VARIANT 247: Xaa = Ile, Phe, or Leu
  VARIANT 249: Xaa = Asp, or Asn
  VARIANT 252: Xaa = Glu, or Asp
  VARIANT 255: Xaa = Lys, or Arg
  VARIANT 257: Xaa = Phe, or Tyr
  VARIANT 258: Xaa = Cys, Ser, or His
  VARIANT 259: Xaa = Gln, or Met
  VARIANT 261: Xaa = Met, Val, or Ala
  VARIANT 263: Xaa = Val, or Ala
  VARIANT 264: Xaa = Gly, or Ser
  VARIANT 266: Xaa = Ile, or Val
  VARIANT 268: Xaa = Asp, or Glu
  VARIANT 269: Xaa = Ser, Cys, or Thr
  VARIANT 270: Xaa = Ile, or Val
  VARIANT 273: Xaa = Val, or Ala
  VARIANT 277: Xaa = Pro, or Ala
  VARIANT 278: Xaa = Tyr, or Phe
  VARIANT 280: Xaa = Asp, or Glu
  VARIANT 281: Xaa = Lys, Ser, or Val
  VARIANT 282: Xaa = Ser, or Ala
  VARIANT 284: Xaa = Ser, or Ala
  VARIANT 286: Xaa = Ile, or Val
  VARIANT 288: Xaa = Thr, or Met
  VARIANT 299: Xaa = Leu, Val, or Ile
  VARIANT 301: Xaa = Ile, or Val
  VARIANT 304: Xaa = Asp, or Glu
  VARIANT 308: Xaa = Val, or Ile
  VARIANT 311: Xaa = Val, or Ile
  VARIANT 312: Xaa = Met, or Leu
  VARIANT 316: Xaa = Ser, or Phe
  VARIANT 317: Xaa = Ile, or Leu
  VARIANT 318: Xaa = Val, or Ser
  VARIANT 320: Xaa = Thr, or Ser
  VARIANT 324: Xaa = Met, or Ile
  VARIANT 325: Xaa = Glu, or Asp
  VARIANT 326: Xaa = Lys, Ser, or Gly
  VARIANT 327: Xaa = Tyr, or Phe
  VARIANT 328: Xaa = Ala, or Gly
  VARIANT 329: Xaa = Asp, or Glu
  VARIANT 330: Xaa = Met, Ile, or Ser
  VARIANT 331: Xaa = Ile, Ala, or Thr
  VARIANT 334: Xaa = Val, or Ile
  VARIANT 338: Xaa = Pro, or Gln
  VARIANT 339: Xaa = His, Gln, or Arg
  VARIANT 341: Xaa = Val, or Ala
  VARIANT 342: Xaa = Met, Ile, or Leu
  VARIANT 343: Xaa = Glu, Asp, or Lys
  VARIANT 345: Xaa = Ile, or Val
  VARIANT 347: Xaa = Lys, or Arg
  VARIANT 354: Xaa = Arg, or Lys
  VARIANT 357: Xaa = Tyr, Phe, or Leu
  VARIANT 358: Xaa = Ser, or Asn
  VARIANT 359: Xaa = Ser, or Asn
  VARIANT 363: Xaa = Ala, or Ser
  VARIANT 366: Xaa = Thr, or Ser
  VARIANT 367: Xaa = Ser, or Ala
  VARIANT 369: Xaa = Met, or Ile
  VARIANT 370: Xaa = Gln, or Leu
  VARIANT 374: Xaa = Glu, or Asp
  VARIANT 379: Xaa = Asp, or Glu
  VARIANT 380: Xaa = Leu, or Val
  VARIANT 381: Xaa = Ile, or Leu
  VARIANT 386: Xaa = His, or Gln
  VARIANT 387: Xaa = Ser, Ala, or Asn
  VARIANT 393: Xaa = Leu, or Met
  VARIANT 398: Xaa = Thr, Ala, or Ser
  VARIANT 399: Xaa = Thr, or Val
  VARIANT 426: Xaa = Ser, or Ala
  VARIANT 433: Xaa = Ala, or Val
MYGGDEVSAIVXDXGSXXCKAGYAGXDXPKAVFPSVXGXXXXXEXXXVDXXXXXXXXXXXXXXXXXXKXKXKRXLXVGSQXXXXRRDHMEXXSXXKDGXVXDWDXVDXIWXHAFXXXLXIXPXEHPMLXAEPXXNXXQQREXXXEXXFEXYKXPALFXAKNXVLTSFAXGRATSXVVDXGGGSTXXXXVHDGXVLQKXVXXSPXGGEFLTDCXXKSLESKGXXIXPRYSFXXKEXXXGXXXXXDXXXPXTTXSYXLXXXRXIXXDXKXXXCRXPDTXXDXXXYXNXPXTSYELPDGQTXEXGAXRFKXPDXXFNPXXXQXIPGXXXXXXXXPSXRGLXXMXXXSXNXCDVDIRXELXXXILLXGGXXSXXQLKXRLEKXXXEESPXXARVKVXASGNXXERRFSVWIGGSILASLGSFQQMWFSKXEYEEHGXSYIQRKCP

SEQ ID NO: 254 - protein, 454 aa, Artificial Sequence
  consensus sequence
  VARIANT 12, 14, 37, 40, 95, 104-105, 118, 132, 142, 160,171, 188, 199, 217, 226-227, 235, 248, 258, 279,283, 299, 312, 314, 321, 324, 325, 330, 337, 347,355, 358, 382, 393-394, 406: Xaa = Ile, Leu, Val, or Met
  VARIANT 17: Xaa = His, or Tyr
  VARIANT 18, 28, 39, 84, 114, 149, 156, 182, 200, 211, 214,277, 295, 297, 333, 341, 376, 379-380, 411, 439: Xaa = Thr, Gly, or Ala
  VARIANT 26, 41, 47, 80, 252, 259, 265, 281, 293, 317, 338,342, 387, 392: Xaa = Glu, or Asp
  VARIANT 42-45, 48, 50-51, 53-54, 56, 58-65, 67-68, 70-78,82, 92, 94, 96, 108, 112, 124, 129, 136, 147, 192,213, 236, 255, 260, 271, 274, 282, 294, 339, 343-346,352, 356, 370, 400: Xaa = any amino acid
  VARIANT 46: Xaa = Met, or Thr
  VARIANT 52: Xaa = Asp, or Lys
  VARIANT 55: Xaa = Lys, or Glu
  VARIANT 57: Xaa = Asn, or Ala
  VARIANT 66: Xaa = Asn, or Ser
  VARIANT 69: Xaa = Asp, or Val
  VARIANT 79: Xaa = Ser, or Val
  VARIANT 87, 128, 155, 238, 244-245, 268, 360, 367: Xaa = His, Lys, or Arg
  VARIANT 89: Xaa = Tyr, or Cys
  VARIANT 97, 206, 253, 270, 291, 340: Xaa = Phe, Tyr, or Trp
  VARIANT 107: Xaa = Pro, or Ser
  VARIANT 121: Xaa = Asn, or Ser
  VARIANT 130: Xaa = Cys, or Arg
  VARIANT 134: Xaa = Asp, or Asn
  VARIANT 146: Xaa = Pro, or Ser
  VARIANT 150: Xaa = Gln, or Ala
  VARIANT 157: Xaa = Ala, or Val
  VARIANT 159: Xaa = Leu, or His
  VARIANT 163: Xaa = Lys, or Asn
  VARIANT 166: Xaa = Val, or Ala
  VARIANT 175: Xaa = Pro, or Ala
  VARIANT 198: Xaa = Thr, or Val
  VARIANT 201: Xaa = Pro, or Ala
  VARIANT 249: Xaa = Arg, or Ser
  VARIANT 250: Xaa = Ala, or Pro
  VARIANT 254: Xaa = Gln, or Lys
  VARIANT 256: Xaa = Glu, or Val
  VARIANT 262: Xaa = Asp, or Asn
  VARIANT 272: Xaa = Gln, or Met
  VARIANT 276: Xaa = Val, or Ala
  VARIANT 286: Xaa = Val, or Ala
  VARIANT 290: Xaa = Pro, or Ala
  VARIANT 301: Xaa = Thr, or Met
  VARIANT 329: Xaa = Ser, or Phe
  VARIANT 331: Xaa = Val, or Ser
  VARIANT 351: Xaa = Pro, or Gln
  VARIANT 354: Xaa = Val, or Ala
  VARIANT 371-372: Xaa = Ser, or Asn
  VARIANT 383: Xaa = Gln, or Leu
  VARIANT 399: Xaa = His, or Gln
  VARIANT 412: Xaa = Thr, or Val
  VARIANT 446: Xaa = Ala, or Val
MYGGDEVSAIVXDXGSXXCKAGYAGXDXPKAVFPSVXGXXXXXXXXXXDXXXXXXXXXXXXXXXXXXXXXXXXXXXXXXXKXKXKRXLXVGXQXXXXRRDHMEXXSXXKDGXVXDWDXVDXIWXHAFXXXLXIXPXEHPMLXAEPXXNXXQQREXXXEXXFEXYKXPALFXAKNXVLTSFAXGRATSXVVDXGGGSTXXXXVHDGXVLQKXVXXSPXGGEFLTDCXXKSLESKGXXIXPRYSFXXKEXXXGXXXXXDXXXPXTTXSYXLXXXRXIXXDXKXXXCRXPDTXXDXXXYXNXPXTSYELPDGQTXEXGAXRFKXPDXXFNPXXXQXIPGXXXXXXXXXXXRGLXXMXXXSXNXCDVDIRXELXXXILLXGGXXSXXQLKXRLEKXXXEESPXXARVKVXASGNXXERRFSVWIGGSILASLGSFQQMWFSKXEYEEHGXSYIQRKCP

SEQ ID NO: 255 - protein, 436 aa, Artificial Sequence
  consensus sequence
  VARIANT 12: Xaa = Val, or Ile
  VARIANT 14: Xaa = Leu, or Val
  VARIANT 17: Xaa = His, or Tyr
  VARIANT 18: Xaa = Thr, or Ser
  VARIANT 26: Xaa = Glu, or Asp
  VARIANT 28: Xaa = Ala, or Thr
  VARIANT 37: Xaa = Ile, or Val
  VARIANT 39: Xaa = Ala, or Ser
  VARIANT 40: Xaa = Val, or Ile
  VARIANT 41: Xaa = Asp, or Glu
  VARIANT 42: Xaa = Gly, or Gln
  VARIANT 43: Xaa = Val, or Thr
  VARIANT 45: Xaa = Ala, or Asp
  VARIANT 46: Xaa = Met, or Thr
  VARIANT 50: Xaa = Val, or Pro
  VARIANT 51: Xaa = Asp, or Lys
  VARIANT 52: Xaa = Ser, or Pro
  VARIANT 53: Xaa = Thr, or Glu
  VARIANT 55: Xaa = Thr, or Glu
  VARIANT 56: Xaa = Asn, or Ala
  VARIANT 57: Xaa = Ser, or Asp
  VARIANT 58: Xaa = Asn, or Ser
  VARIANT 59: Xaa = Ser, or Ala
  VARIANT 60: Xaa = Glu, or Ser
  VARIANT 64: Xaa = Thr, or Asn
  VARIANT 65: Xaa = Glu, or Asp
  VARIANT 66: Xaa = Ser, or Val
  VARIANT 67: Xaa = Glu, or Asp
  VARIANT 69: Xaa = Glu, or Ala
  VARIANT 71: Xaa = Gly, or Thr
  VARIANT 74: Xaa = Lys, or Arg
  VARIANT 81: Xaa = Ala, or Glu
  VARIANT 82: Xaa = Met, or Leu
  VARIANT 83: Xaa = Ser, or Glu
  VARIANT 84: Xaa = Tyr, or Phe
  VARIANT 92: Xaa = Leu, or Ile
  VARIANT 94: Xaa = Pro, or Ser
  VARIANT 95: Xaa = Ile, or Met
  VARIANT 99: Xaa = Ile, or Thr
  VARIANT 101: Xaa = Ser, or Thr
  VARIANT 105: Xaa = Leu, or Ile
  VARIANT 111: Xaa = Glu, or Asn
  VARIANT 115: Xaa = Lys, or Arg
  VARIANT 116: Xaa = Ser, or Arg
  VARIANT 117: Xaa = Cys, or Arg
  VARIANT 119: Xaa = Met, or Leu
  VARIANT 120: Xaa = Ile, Asp, or Asn
  VARIANT 122: Xaa = Thr, or Glu
  VARIANT 128: Xaa = Leu, or Ile
  VARIANT 132: Xaa = Pro, or Ser
  VARIANT 133: Xaa = Leu, or Thr
  VARIANT 136: Xaa = Gln, or Ala
  VARIANT 146: Xaa = Met, or Ile
  VARIANT 149: Xaa = Lys, or Asn
  VARIANT 157: Xaa = Met, or Leu
  VARIANT 161: Xaa = Pro, or Ala
  VARIANT 168: Xaa = Thr, or Ser
  VARIANT 178: Xaa = Cys, or Ser
  VARIANT 184: Xaa = Thr, or Val
  VARIANT 185: Xaa = Ile, or Val
  VARIANT 187: Xaa = Pro, or Ala
  VARIANT 192: Xaa = Tyr, or Phe
  VARIANT 197: Xaa = Ala, or Ser
  VARIANT 199: Xaa = Val, Ser, or Ala
  VARIANT 200: Xaa = Ser, or Thr
  VARIANT 203: Xaa = Leu, Val, or Ile
  VARIANT 212: Xaa = Leu, or Met
  VARIANT 213: Xaa = Leu, or Met
  VARIANT 221: Xaa = Ile, or Val
  VARIANT 222: Xaa = Lys, or Val
  VARIANT 231: Xaa = Arg, or Lys
  VARIANT 234: Xaa = Val, or Ile
  VARIANT 235: Xaa = Arg, or Ser
  VARIANT 236: Xaa = Ala, or Pro
  VARIANT 238: Xaa = Glu, or Asp
  VARIANT 239: Xaa = Phe, Tyr, Gln, or Lys
  VARIANT 240: Xaa = Val, or Ile
  VARIANT 241: Xaa = Glu, or Val
  VARIANT 243: Xaa = Val, or Leu
  VARIANT 245: Xaa = Ile, Leu, or Phe
  VARIANT 247: Xaa = Asp, or Asn
  VARIANT 250: Xaa = Glu, or Asp
  VARIANT 253: Xaa = Lys, or Arg
  VARIANT 255: Xaa = Phe, or Tyr
  VARIANT 256: Xaa = Cys, or His
  VARIANT 257: Xaa = Gln, or Met
  VARIANT 259: Xaa = Met, or Ala
  VARIANT 261: Xaa = Val, or Ala
  VARIANT 262: Xaa = Gly, or Ser
  VARIANT 264: Xaa = Ile, or Val
  VARIANT 266: Xaa = Asp, or Glu
  VARIANT 267: Xaa = Ser, or Thr
  VARIANT 268: Xaa = Ile, or Val
  VARIANT 275: Xaa = Pro, or Ala
  VARIANT 276: Xaa = Tyr, or Phe
  VARIANT 278: Xaa = Asp, or Glu
  VARIANT 279: Xaa = Lys, or Val
  VARIANT 280: Xaa = Ser, or Ala
  VARIANT 282: Xaa = Ser, or Ala
  VARIANT 284: Xaa = Ile, or Val
  VARIANT 297: Xaa = Leu, or Ile
  VARIANT 298: Xaa = Glu, Ile, or Val
  VARIANT 301: Xaa = Asp, or Glu
  VARIANT 305: Xaa = Val, or Ile
  VARIANT 308: Xaa = Val, or Ile
  VARIANT 309: Xaa = Met, or Leu
  VARIANT 313: Xaa = Ser, or Phe
  VARIANT 314: Xaa = Ile, or Leu
  VARIANT 315: Xaa = Val, or Ser
  VARIANT 321: Xaa = Met, or Ile
  VARIANT 322: Xaa = Glu, or Asp
  VARIANT 323: Xaa = Lys, or Gly
  VARIANT 324: Xaa = Tyr, or Phe
  VARIANT 325: Xaa = Ala, or Gly
  VARIANT 327: Xaa = Met, or Ser
  VARIANT 328: Xaa = Ile, or Thr
  VARIANT 331: Xaa = Val, or Ile
  VARIANT 335: Xaa = Pro, or Gln
  VARIANT 336: Xaa = His, or Arg
  VARIANT 338: Xaa = Val, or Ala
  VARIANT 339: Xaa = Met, Ile, or Leu
  VARIANT 340: Xaa = Glu, Asp, or Lys
  VARIANT 342: Xaa = Ile, or Val
  VARIANT 344: Xaa = Lys, or Arg
  VARIANT 351: Xaa = Arg, or Lys
  VARIANT 354: Xaa = Tyr, Phe, or Leu
  VARIANT 356: Xaa = Ser, or Asn
  VARIANT 357: Xaa = Ile, or Leu
  VARIANT 359: Xaa = Ala, or Ser
  VARIANT 362: Xaa = Thr, or Ser
  VARIANT 365: Xaa = Met, or Ile
  VARIANT 366: Xaa = Gln, or Leu
  VARIANT 370: Xaa = Glu, or Asp
  VARIANT 375: Xaa = Asp, or Glu
  VARIANT 376: Xaa = Leu, or Val
  VARIANT 377: Xaa = Ile, or Leu
  VARIANT 382: Xaa = His, or Gln
  VARIANT 383: Xaa = Ser, Ala, or Asn
  VARIANT 389: Xaa = Leu, or Met
  VARIANT 394: Xaa = Thr, or Ser
  VARIANT 395: Xaa = Thr, or Val
  VARIANT 416: Xaa = Gln, or Met
  VARIANT 421: Xaa = Ser, or Ala
  VARIANT 428: Xaa = Ala, or Val
MYGGDEVSAIVXDXGSXXCKAGYAGXDXPKAVFPSVXGXXXXXEXXDVDXXXXKXXXXXXDSKXXXXKXKXKRXLYVGSQXXXXRRDHMEVXSXXKDGXVXDWDXVDNIWXHAFXXXLXXPXEHPMLXAEPXXNTXQQREKAAELXFEXYKVPALFXAKNXVLTSFAXGRATSLVVDXGGGSTXXSXVHDGXVLQKXVXXSPXGGEFLTDCXXKSLESKGXXIRPRYSFKXKEXXXGXXXXDXDXPXTTXSYXLXXXRXIXXDXKXXXCRVPDTXXDXXXYXNXPTTSYELPDGQTXXGAXRFKXPDXXFNPXXXQTIPGXXXXXDXXPSXRGLXXMXXXSXNXCDVDIRXELXSXXLXGGXSSXXQLKXRLEKXXXEESPXXARVKVXASGNXXERRFSVWIGGSILASLGSFQXWFSKXEYEEHGXSYIQRKCP

SEQ ID NO: 256 - protein, 446 aa, Artificial Sequence
  consensus sequence
  VARIANT 12, 14, 37, 40, 87, 97, 100, 110, 124, 134, 152,163, 191, 209, 218-219, 227, 240, 247, 250, 271,275, 291, 304, 306, 313, 316-317, 322, 329, 339,347, 350, 374, 385-386, 398: Xaa = Ile, Leu, Val, or Met
  VARIANT 17: Xaa = His, or Tyr
  VARIANT 18, 28, 39, 59, 76, 106, 174, 203, 206, 269, 274,287, 289, 333, 368, 371, 403, 431: Xaa = Thr, Gly, or Ala
  VARIANT 26, 41, 70, 72, 244, 257, 273, 285, 309, 330,379, 384: Xaa = Glu, or Asp
  VARIANT 42: Xaa = Gly, or Gln
  VARIANT 43: Xaa = Val, or Thr
  VARIANT 45: Xaa = Ala, or Asp
  VARIANT 46: Xaa = Met, or Thr
  VARIANT 48, 65-69, 84, 205, 252, 337-338, 348, 362, 392: Xaa = any amino acid
  VARIANT 50: Xaa = Val, or Pro
  VARIANT 51: Xaa = Asp, or Lys
  VARIANT 52: Xaa = Ser, or Pro
  VARIANT 53: Xaa = Thr, or Glu
  VARIANT 55: Xaa = Thr, or Glu
  VARIANT 56: Xaa = Asn, or Ala
  VARIANT 57: Xaa = Ser, or Asp
  VARIANT 58: Xaa = Asn, or Ser
  VARIANT 60: Xaa = Glu, or Ser
  VARIANT 64: Xaa = Thr, or Asn
  VARIANT 71: Xaa = Ser, or Val
  VARIANT 74: Xaa = Glu, or Ala
  VARIANT 79, 120, 237, 260, 344, 352, 359: Xaa = His, Lys, or Arg
  VARIANT 86: Xaa = Ala, or Glu
  VARIANT 88: Xaa = Ser, or Glu
  VARIANT 89, 198, 245, 262, 283, 332: Xaa = Phe, Tyr, or Trp
  VARIANT 99: Xaa = Pro, or Ser
  VARIANT 104: Xaa = Ile, or Thr
  VARIANT 116: Xaa = Glu, or Asn
  VARIANT 121: Xaa = Ser, or Arg
  VARIANT 122: Xaa = Cys, or Arg
  VARIANT 126: Xaa = Asp, or Asn
  VARIANT 128: Xaa = Thr, or Glu
  VARIANT 138: Xaa = Pro, or Ser
  VARIANT 139: Xaa = Leu, or Thr
  VARIANT 142: Xaa = Gln, or Ala
  VARIANT 155: Xaa = Lys, or Asn
  VARIANT 167: Xaa = Pro, or Ala
  VARIANT 184: Xaa = Cys, or Ser
  VARIANT 190: Xaa = Thr, or Val
  VARIANT 193: Xaa = Pro, or Ala
  VARIANT 228: Xaa = Lys, or Val
  VARIANT 241: Xaa = Arg, or Ser
  VARIANT 242: Xaa = Ala, or Pro
  VARIANT 246: Xaa = Gln, or Lys
  VARIANT 248: Xaa = Glu, or Val
  VARIANT 254: Xaa = Asp, or Asn
  VARIANT 263: Xaa = Cys, or His
  VARIANT 264: Xaa = Gln, or Met
  VARIANT 266: Xaa = Met, or Ala
  VARIANT 268: Xaa = Val, or Ala
  VARIANT 282: Xaa = Pro, or Ala
  VARIANT 286: Xaa = Lys, or Val
  VARIANT 321: Xaa = Ser, or Phe
  VARIANT 323: Xaa = Val, or Ser
  VARIANT 331: Xaa = Lys, or Gly
  VARIANT 335: Xaa = Met, or Ser
  VARIANT 336: Xaa = Ile, or Thr
  VARIANT 343: Xaa = Pro, or Gln
  VARIANT 346: Xaa = Val, or Ala
  VARIANT 364: Xaa = Ser, or Asn
  VARIANT 375: Xaa = Gln, or Leu
  VARIANT 391: Xaa = His, or Gln
  VARIANT 404: Xaa = Thr, or Val
  VARIANT 438: Xaa = Ala, or Val
MYGGDEVSAIVXDXGSXXCKAGYAGXDXPKAVFPSVXGXXXXXEXXDXDXXXXKXXXXXXDSKXXXXXXXXXKXKXKRXLYVGXQXXXXRRDHMEVXSXXKDGXVXDWDXVDNIWXHAFXXXLXIXPXEHPMLXAEPXXNTXQQREKAAELXFEXYKVPALFXAKNXVLTSFAXGRATSLVVDXGGGSTXXSXVHDGXVLQKXVXXSPXGGEFLTDCXXKSLESKGXXIRPRYSFKXKEXXXGXXXXXDXDXPXTTXSYXLXXXRXIXXDXKXXXCRVPDTXXDXXXYXNXPTTSYELPDGQTXEXGAXRFKXPDXXFNPXXXQTIPGXXXXXDXXXXXRGLXXMXXXSXNXCDVDIRXELXSXILLXGGXSSXXQLKXRLEKXXXEESPXXARVKVXASGNXXERRFSVWIGGSILASLGSFQQMWFSKTEYEEHGXSYIQRKCP

SEQ ID NO: 257 - protein, 441 aa, Artificial Sequence
  consensus sequence
  VARIANT 12: Xaa = Val, or Ile
  VARIANT 37: Xaa = Ile, or Val
  VARIANT 40: Xaa = Val, or Ile
  VARIANT 45: Xaa = Ala, or Gln
  VARIANT 47: Xaa = Asp, or Glu
  VARIANT 50: Xaa = Val, or Ala
  VARIANT 52: Xaa = Ser, or Asn
  VARIANT 53: Xaa = Thr, Gly, or Ala
  VARIANT 54: Xaa = Lys, or Glu
  VARIANT 55: Xaa = Thr, or Lys
  VARIANT 57: Xaa = Ser, or Asn
  VARIANT 59: Xaa = Ser, or Asn
  VARIANT 60: Xaa = Glu, or Asn
  VARIANT 61: Xaa = Asp, or Val
  VARIANT 62: Xaa = Ser, or Arg
  VARIANT 63: Xaa = Lys, or Asn
  VARIANT 64: Xaa = Thr, or Ala
  VARIANT 65: Xaa = Glu, Asp, or Lys
  VARIANT 67: Xaa = Glu, or Asp
  VARIANT 69: Xaa = Glu, Ala, or Asp
  VARIANT 76: Xaa = Tyr, or Cys
  VARIANT 81: Xaa = Ala, or Ser
  VARIANT 82: Xaa = Met, or Leu
  VARIANT 83: Xaa = Ser, Gly, or Asn
  VARIANT 91: Xaa = Val, or Ile
  VARIANT 95: Xaa = Ile, or Phe
  VARIANT 99: Xaa = Ile, or Val
  VARIANT 101: Xaa = Ser, or Ala
  VARIANT 105: Xaa = Leu, or Ile
  VARIANT 108: Xaa = Asn, or Ser
  VARIANT 111: Xaa = Glu, or Asp
  VARIANT 115: Xaa = Lys, or Arg
  VARIANT 116: Xaa = Ser, or Asp
  VARIANT 119: Xaa = Met, or Leu
  VARIANT 123: Xaa = Thr, or Lys
  VARIANT 133: Xaa = Pro, or Ser
  VARIANT 134: Xaa = Leu, or Ser
  VARIANT 136: Xaa = Thr, or Ser
  VARIANT 142: Xaa = Lys, or Arg
  VARIANT 143: Xaa = Ala, or Thr
  VARIANT 144: Xaa = Ala, or Val
  VARIANT 146: Xaa = Leu, or His
  VARIANT 153: Xaa = Val, or Ala
  VARIANT 158: Xaa = Met, or Leu
  VARIANT 162: Xaa = Pro, or Ala
  VARIANT 169: Xaa = Thr, or Ser
  VARIANT 175: Xaa = Leu, or Val
  VARIANT 179: Xaa = Cys, or Gly
  VARIANT 186: Xaa = Ile, or Val
  VARIANT 187: Xaa = Ser, or Ala
  VARIANT 200: Xaa = Val, or Ala
  VARIANT 201: Xaa = Ser, or Thr
  VARIANT 204: Xaa = Leu, or Ile
  VARIANT 214: Xaa = Leu, or Met
  VARIANT 223: Xaa = Lys, or Met
  VARIANT 225: Xaa = Arg, or Lys
  VARIANT 231: Xaa = Lys, or Arg
  VARIANT 235: Xaa = Val, or Ile
  VARIANT 237: Xaa = Ala, or Pro
  VARIANT 242: Xaa = Val, or Thr
  VARIANT 243: Xaa = Glu, or Val
  VARIANT 245: Xaa = Val, or Leu
  VARIANT 246: Xaa = Asp, or Glu
  VARIANT 247: Xaa = Ile, or Phe
  VARIANT 249: Xaa = Asp, or Asn
  VARIANT 258: Xaa = Cys, or Ser
  VARIANT 261: Xaa = Met, or Val
  VARIANT 263: Xaa = Val, or Ala
  VARIANT 264: Xaa = Gly, or Ser
  VARIANT 268: Xaa = Asp, or Glu
  VARIANT 269: Xaa = Ser, or Cys
  VARIANT 270: Xaa = Ile, or Val
  VARIANT 273: Xaa = Val, or Ala
  VARIANT 280: Xaa = Asp, or Glu
  VARIANT 281: Xaa = Lys, or Ser
  VARIANT 282: Xaa = Ser, or Ala
  VARIANT 288: Xaa = Thr, or Met
  VARIANT 299: Xaa = Leu, or Val
  VARIANT 308: Xaa = Val, or Ile
  VARIANT 312: Xaa = Met, or Leu
  VARIANT 317: Xaa = Ile, or Leu
  VARIANT 320: Xaa = Thr, or Ser
  VARIANT 326: Xaa = Lys, or Ser
  VARIANT 327: Xaa = Tyr, or Phe
  VARIANT 329: Xaa = Asp, or Glu
  VARIANT 330: Xaa = Met, or Ile
  VARIANT 331: Xaa = Ile, or Ala
  VARIANT 339: Xaa = His, or Gln
  VARIANT 342: Xaa = Met, or Ile
  VARIANT 357: Xaa = Tyr, or Phe
  VARIANT 358: Xaa = Ser, or Asn
  VARIANT 367: Xaa = Ser, or Ala
  VARIANT 381: Xaa = Ile, or Leu
  VARIANT 386: Xaa = His, or Gln
  VARIANT 387: Xaa = Ser, or Ala
  VARIANT 398: Xaa = Thr, or Ala
MYGGDEVSAIVXDLGSHTCKAGYAGEDAPKAVFPSVXGAXDGVEXMXVDXDXXXXNXNXXXXXXXSXKXKGKRKLXVGSQXXXYRRDHMEXLSPXKDGXVXDWDXVDXIWXHAFXXCLXIDPXEHPMLLAEPXXNXQQQREXXXEXMFEKYKXPALFXAKNXVLTSFAXGRATSXVVDXGGGSTTXXPVHDGYVLQKAVXXSPXGGEFLTDCLXKSLESKGIXIXPRYSFXRKEXRXGEFQXXDXXXPXTTESYKLFXQRXIXXDIKXXXCRXPDTPYDXXXYSNIPXTSYELPDGQTXEIGADRFKXPDVXFNPSXVQXIPGMEXXAXXXPSVRGLPXMVXESINKCDVDIRRELXXSILLAGGTXSMQQLKERLEKDLXEESPXXARVKVLASGNXTERRFSVWIGGSILASLGSFQQMWFSKSEYEEHGASYIQRKCP

SEQ ID NO: 258 - protein, 449 aa, Artificial Sequence
  consensus sequence
  VARIANT 12, 37, 40, 90, 99, 107, 113, 127, 166, 183, 194,212, 222, 243, 253, 269, 278, 307, 316, 320, 325,338, 350, 389: Xaa = Ile, Leu, Val, or Met
  VARIANT 42-44, 50, 58-64, 70-73, 77, 91: Xaa = any amino acid
  VARIANT 45: Xaa = Ala, or Gln
  VARIANT 47, 75, 119, 254, 276, 288, 337: Xaa = Glu, or Asp
  VARIANT 51: Xaa = Val, or Ala
  VARIANT 53: Xaa = Ser, or Asn
  VARIANT 54, 89, 109, 144, 151, 177, 195, 209, 272, 290,328, 375, 395, 406: Xaa = Thr, Gly, or Ala
  VARIANT 55: Xaa = Lys, or Glu
  VARIANT 56: Xaa = Thr, or Lys
  VARIANT 65: Xaa = Ser, or Asn
  VARIANT 67: Xaa = Ser, or Asn
  VARIANT 68: Xaa = Glu, or Asn
  VARIANT 69: Xaa = Asp, or Val
  VARIANT 84: Xaa = Tyr, or Cys
  VARIANT 103: Xaa = Ile, or Phe
  VARIANT 116: Xaa = Asn, or Ser
  VARIANT 123, 150, 233, 239: Xaa = His, Lys, or Arg
  VARIANT 124: Xaa = Ser, or Asp
  VARIANT 131: Xaa = Thr, or Lys
  VARIANT 141: Xaa = Pro, or Ser
  VARIANT 142: Xaa = Leu, or Ser
  VARIANT 152: Xaa = Ala, or Val
  VARIANT 154: Xaa = Leu, or His
  VARIANT 161: Xaa = Val, or Ala
  VARIANT 170: Xaa = Pro, or Ala
  VARIANT 187: Xaa = Cys, or Gly
  VARIANT 208: Xaa = Val, or Ala
  VARIANT 231: Xaa = Lys, or Met
  VARIANT 245: Xaa = Ala, or Pro
  VARIANT 250: Xaa = Val, or Thr
  VARIANT 251: Xaa = Glu, or Val
  VARIANT 255: Xaa = Ile, or Phe
  VARIANT 257: Xaa = Asp, or Asn
  VARIANT 266: Xaa = Cys, or Ser
  VARIANT 271: Xaa = Val, or Ala
  VARIANT 277: Xaa = Ser, or Cys
  VARIANT 281: Xaa = Val, or Ala
  VARIANT 289: Xaa = Lys, or Ser
  VARIANT 296: Xaa = Thr, or Met
  VARIANT 334: Xaa = Lys, or Ser
  VARIANT 335, 365: Xaa = Phe, Tyr, or Trp
  VARIANT 339: Xaa = Ile, or Ala
  VARIANT 347: Xaa = His, or Gln
  VARIANT 366: Xaa = Ser, or Asn
  VARIANT 394: Xaa = His, or Gln
MYGGDEVSAIVXDLGSHTCKAGYAGEDAPKAVFPSVXGAXDXXXXMXVDXXDXXXXNXXXXXXXXNXXXXXXXSXKXKGKRKLXVGSQXXXYRRDHMEXLSPXKDGXVXDWDXVDXIWXHAFXXCLXIDPXEHPMLLAEPXXNXQQQREXXXEXMFEKYKXPALFXAKNXVLTSFAXGRATSXVVDXGGGSTTXXPVHDGYVLQKAVXXSPXGGEFLTDCLXKSLESKGIXIXPRYSFXRKEXRXGEFQXXDXXXPXTTESYKLFXQRXIXXDIKXXXCRXPDTPYDXXXYSNIPXTSYELPDGQTXEIGADRFKXPDVXFNPSXVQXIPGMEXXAXXXPSVRGLPXMVXESINKCDVDIRRELXXSILLAGGTXSMQQLKERLEKDLXEESPXXARVKVLASGNXTERRFSVWIGGSILASLGSFQQMWFSKSEYEEHGASYIQRKCP

SEQ ID NO: 259 - protein, 1192 aa, Artificial Sequence
  consensus sequence
  VARIANT 2: Xaa = Ser, or Asn
  VARIANT 3: Xaa = Ser, or Gln
  VARIANT 4: Xaa = Phe, or His
  VARIANT 5: Xaa = Phe, or Pro
  VARIANT 8: Xaa = Val, or Leu
  VARIANT 9: Xaa = Thr, or Asn
  VARIANT 10: Xaa = Thr, or Lys
  VARIANT 14: Xaa = Phe, or Val
  VARIANT 15: Xaa = Ser, or Leu
  VARIANT 16: Xaa = Phe, or Leu
  VARIANT 17: Xaa = Phe, or Leu
  VARIANT 18: Xaa = Ser, or Ile
  VARIANT 19: Xaa = Leu, or Phe
  VARIANT 20: Xaa = Ser, or Phe
  VARIANT 21: Xaa = Phe, or Leu
  VARIANT 22: Xaa = Gln, or Pro
  VARIANT 26: Xaa = Ser, or Ala
  VARIANT 27: Xaa = Gln, or Ala
  VARIANT 31: Xaa = Arg, or Lys
  VARIANT 32: Xaa = Glu, or Asp
  VARIANT 33: Xaa = Ile, or Ser
  VARIANT 34: Xaa = His, or Gln
  VARIANT 37: Xaa = Ile, Leu, or Glu
  VARIANT 38: Xaa = Ser, or Glu
  VARIANT 40: Xaa = Lys, or Arg
  VARIANT 41: Xaa = Asp, Ala, or Gln
  VARIANT 42: Xaa = Val, or Ala
  VARIANT 43: Xaa = Leu, or Val
  VARIANT 45: Xaa = Asp, Thr, or Asn
  VARIANT 46: Xaa = Lys, Pro, or Gln
  VARIANT 47: Xaa = Asn, Thr, or Ala
  VARIANT 48: Xaa = Leu, Ala, or Val
  VARIANT 50: Xaa = Pro, Gln, Lys, or Gly
  VARIANT 51: Xaa = Asp, Asn, or Gly
  VARIANT 53: Xaa = Ser, Leu, or Glu
  VARIANT 54: Xaa = Ser, or Gly
  VARIANT 55: Xaa = Asn, Ser, or Gly
  VARIANT 56: Xaa = Lys, Thr, Asp, or Arg
  VARIANT 57: Xaa = Asn, Asp, or Gly
  VARIANT 58: Xaa = Pro, Ala, or Ser
  VARIANT 60: Xaa = Thr, Ser, or Arg
  VARIANT 61: Xaa = Phe, or Trp
  VARIANT 62: Xaa = Asp, Thr, Pro, or Arg
  VARIANT 64: Xaa = Val, or Ala
  VARIANT 65: Xaa = Thr, Ser, or Gly
  VARIANT 67: Xaa = Arg, Lys, or Ser
  VARIANT 68: Xaa = Asp, or Asn
  VARIANT 69: Xaa = Asp, Ser, or Gly
  VARIANT 70: Xaa = Lys, or Arg
  VARIANT 71: Xaa = Val, Leu, or Ile
  VARIANT 72: Xaa = Thr, Ser, or Val
  VARIANT 73: Xaa = Ser, or Gly
  VARIANT 74: Xaa = Ile, or Leu
  VARIANT 75: Xaa = Asp, or Ser
  VARIANT 77: Xaa = Ser, Ala, or Arg
  VARIANT 78: Xaa = Ser, Asn, or Gly
  VARIANT 79: Xaa = Lys, Thr, Val, or Gly
  VARIANT 80: Xaa = Pro, Phe, or Gly
  VARIANT 81: Xaa = Leu, or Val
  VARIANT 82: Xaa = Asn, Ser, or Thr
  VARIANT 83: Xaa = Val, Ala, or Gly
  VARIANT 84: Xaa = Gly, Asp, Glu, or Thr
  VARIANT 85: Xaa = Phe, or Leu
  VARIANT 86: Xaa = Ser, Arg, or Asn
  VARIANT 87: Xaa = Ala, or Leu
  VARIANT 89: Xaa = Ser, Thr, or Ala
  VARIANT 90: Xaa = Ser, or Ala
  VARIANT 91: Xaa = Ser, Tyr, Thr, or Asn
  VARIANT 93: Xaa = Leu, or Thr
  VARIANT 94: Xaa = Ser, Pro, Gln, or Ala
  VARIANT 96: Xaa = Thr, Ser, Gly, or Pro
  VARIANT 97: Xaa = Gly, Asn, or Ser
  VARIANT 98: Xaa = Leu, or Val
  VARIANT 99: Xaa = Glu, or Gln
  VARIANT 100: Xaa = Ser, Val, or Asn
  VARIANT 102: Xaa = Phe, Val, Ser, or Tyr
  VARIANT 104: Xaa = Ser, Lys, Arg, or Gln
  VARIANT 105: Xaa = Asn, or Gly
  VARIANT 106: Xaa = Ser, Ala, or Asn
  VARIANT 107: Xaa = His, Asn, or Tyr
  VARIANT 108: Xaa = Ile, Leu, Val, or Phe
  VARIANT 109: Xaa = Asn, or Ser
  VARIANT 110: Xaa = Gly, or Ser
  VARIANT 111: Xaa = Ser, or Ala
  VARIANT 112: Xaa = Val, Leu, or Ser
  VARIANT 113: Xaa = Ser, Thr, or Gly
  VARIANT 114: Xaa = Gly, or Ser
  VARIANT 115: Xaa = Phe, Ala, or Asp
  VARIANT 116: Xaa = Lys, Gln, Arg, or Ser
  VARIANT 117: Xaa = Cys, or Ser
  VARIANT 118: Xaa = Ser, or Gly
  VARIANT 119: Xaa = Ala, Val, Ser, or Gly
  VARIANT 120: Xaa = Ser, Thr, or Lys
  VARIANT 122: Xaa = Thr, Asp, or Gln
  VARIANT 123: Xaa = Ser, Ala, or Val
  VARIANT 124: Xaa = Leu, or Ile
  VARIANT 127: Xaa = Ser, or Ala
  VARIANT 128: Xaa = Arg, Glu, Gly, or Ser
  VARIANT 130: Xaa = Ser, Thr, Ala, or Leu
  VARIANT 131: Xaa = Leu, or Ile
  VARIANT 132: Xaa = Ser, or Arg
  VARIANT 133: Xaa = Gly, or Asp
  VARIANT 134: Xaa = Pro, Ser, or Tyr
  VARIANT 135: Xaa = Val, Ile, or Ser
  VARIANT 136: Xaa = Thr, Ser, Ala, or Leu
  VARIANT 137: Xaa = Thr, Asp, or Val
  VARIANT 138: Xaa = Leu, Ile, Val, or Asp
  VARIANT 139: Xaa = Thr, Ser, Ala, or Tyr
  VARIANT 140: Xaa = Ser, Ala, or Val
  VARIANT 141: Xaa = Leu, or Phe
  VARIANT 142: Xaa = Gly, Ala, or Ser
  VARIANT 143: Xaa = Ser, Val, or Lys
  VARIANT 145: Xaa = Ser, or Gly
  VARIANT 146: Xaa = Gly, or Asn
  VARIANT 148: Xaa = Lys, or Val
  VARIANT 149: Xaa = Phe, Ser, or Thr
  VARIANT 150: Xaa = Leu, or Val
  VARIANT 152: Xaa = Val, Leu, or Phe
  VARIANT 154: Xaa = Ser, Lys, Gly, or Asn
  VARIANT 155: Xaa = Asn, or Asp
  VARIANT 156: Xaa = Thr, Phe, Val, or Lys
  VARIANT 157: Xaa = Leu, or Gly
  VARIANT 158: Xaa = Asp, or Ala
  VARIANT 159: Xaa = Phe, Pro, or Ala
  VARIANT 160: Xaa = Pro, Lys, or Val
  VARIANT 161: Xaa = Gly, or Val
  VARIANT 162: Xaa = Lys, or Gly
  VARIANT 163: Xaa = Val, Glu, Gly, or Leu
  VARIANT 164: Xaa = Ser, Met, or Gly
  VARIANT 165: Xaa = Gly, Leu, or Ala
  VARIANT 166: Xaa = Gly, Lys, or Pro
  VARIANT 167: Xaa = Leu, Gly, Pro, or Ser
  VARIANT 168: Xaa = Lys, Ala, Gly, or Ser
  VARIANT 169: Xaa = Leu, Thr, or Phe
  VARIANT 170: Xaa = Asn, Phe, Ala, or Lys
  VARIANT 171: Xaa = Ser, or Gly
  VARIANT 173: Xaa = Glu, Gln, Asp, or Thr
  VARIANT 174: Xaa = Val, Ser, or Thr
  VARIANT 175: Xaa = Leu, or Val
  VARIANT 177: Xaa = Leu, or Phe
  VARIANT 179: Xaa = Ala, Tyr, or Asn
  VARIANT 181: Xaa = Ser, Asn, Lys, or Ile
  VARIANT 182: Xaa = Ile, or Leu
  VARIANT 183: Xaa = Ser, or Thr
  VARIANT 184: Xaa = Gly, or Asp
  VARIANT 185: Xaa = Ala, Phe, Asp, or Glu
  VARIANT 186: Xaa = Asn, Ser, or Lys
  VARIANT 187: Xaa = Val, Leu, Asp, or Ile
  VARIANT 188: Xaa = Val, Phe, Leu, or Pro
  VARIANT 189: Xaa = Gly, Pro, Arg, or Glu
  VARIANT 190: Xaa = Trp, or Ser
  VARIANT 191: Xaa = Val, Met, or Phe
  VARIANT 192: Xaa = Leu, Ser, Val, or Ile
  VARIANT 193: Xaa = Ser, or Asp
  VARIANT 194: Xaa = Asp, Met, Ala, or Glu
  VARIANT 195: Xaa = Gly, or Phe
  VARIANT 196: Xaa = Cys, Phe, Val, or Pro
  VARIANT 197: Xaa = Gly, Val, or Ala
  VARIANT 198: Xaa = Glu, Ala, or Ser
  VARIANT 199: Xaa = Leu, or Val
  VARIANT 200: Xaa = Lys, Glu, or Arg
  VARIANT 201: Xaa = His, Phe, Trp, or Tyr
  VARIANT 202: Xaa = Leu, or Phe
  VARIANT 203: Xaa = Ala, Ser, or Asp
  VARIANT 204: Xaa = Ile, or Leu
  VARIANT 205: Xaa = Ser, Lys, Ala, or Thr
  VARIANT 206: Xaa = Gly, Leu, or His
  VARIANT 208: Xaa = Lys, Arg, or Asn
  VARIANT 209: Xaa = Ile, Leu, or Phe
  VARIANT 210: Xaa = Ser, or Ala
  VARIANT 212: Xaa = Asp, Ser, or Val
  VARIANT 213: Xaa = Val, Ile, Pro, or Leu
  VARIANT 214: Xaa = Asp, Pro, Glu, or Ser
  VARIANT 215: Xaa = Val, Glu, or Phe
  VARIANT 216: Xaa = Ser, Leu, Thr, or Gly
  VARIANT 217: Xaa = Arg, Asp, Asn, or Met
  VARIANT 218: Xaa = Cys, or Phe
  VARIANT 219: Xaa = Val, Lys, or Gly
  VARIANT 222: Xaa = Glu, or Ser
  VARIANT 223: Xaa = Phe, or Tyr
  VARIANT 224: Xaa = Leu, or Phe
  VARIANT 225: Xaa = Asp, or Ser
  VARIANT 226: Xaa = Val, or Leu
  VARIANT 228: Xaa = Ser, Ala, or Gln
  VARIANT 234: Xaa = Gly, or Val
  VARIANT 235: Xaa = Ile, or Phe
  VARIANT 237: Xaa = Phe, or Ser
  VARIANT 238: Xaa = Leu, or Phe
  VARIANT 239: Xaa = Gly, or Lys
  VARIANT 243: Xaa = Ala, Asn, or Gly
  VARIANT 246: Xaa = His, or Tyr
  VARIANT 249: Xaa = Ile, or Leu
  VARIANT 251: Xaa = Gly, or Ser
  VARIANT 252: Xaa = Asn, or Val
  VARIANT 253: Xaa = Lys, or Leu
  VARIANT 254: Xaa = Leu, Phe, or Ile
  VARIANT 255: Xaa = Ser, Tyr, or Val
  VARIANT 257: Xaa = Asp, or Glu
  VARIANT 258: Xaa = Phe, Ile, or Val
  VARIANT 259: Xaa = Ser, Gly, or Pro
  VARIANT 260: Xaa = Arg, Ser, Gly, or Ile
  VARIANT 261: Xaa = Ala, or Ser
  VARIANT 262: Xaa = Ile, or Leu
  VARIANT 263: Xaa = Ser, or Pro
  VARIANT 264: Xaa = Thr, Ser, Asp, or Asn
  VARIANT 266: Xaa = Thr, Gly, or Arg
  VARIANT 267: Xaa = Glu, Lys, Gly, or Phe
  VARIANT 269: Xaa = Lys, Ser, or Glu
  VARIANT 270: Xaa = Leu, Phe, Val, or Thr
  VARIANT 273: Xaa = Ile, or Leu
  VARIANT 274: Xaa = Ser, or Thr
  VARIANT 275: Xaa = Ser, Asn, Phe, or Arg
  VARIANT 277: Xaa = Gln, His, or Asn
  VARIANT 278: Xaa = Phe, or Leu
  VARIANT 279: Xaa = Val, or Ala
  VARIANT 281: Xaa = Pro, Leu, Val, or Lys
  VARIANT 282: Xaa = Ile, Val, or Phe
  VARIANT 284: Xaa = Pro, Lys, or Gly
  VARIANT 285: Xaa = Leu, Ala, or Gly
  VARIANT 286: Xaa = Pro, Gly, or Ser
  VARIANT 287: Xaa = Leu, Ser, or Phe
  VARIANT 288: Xaa = Lys, Glu, Thr, or Gln
  VARIANT 289: Xaa = Ser, or Asn
  VARIANT 291: Xaa = Gln, Asn, or Lys
  VARIANT 292: Xaa = Tyr, Ala, or Gln
  VARIANT 294: Xaa = Ser, Tyr, or Asn
  VARIANT 296: Xaa = Ala, Arg, or Ser
  VARIANT 297: Xaa = Glu, Gly, Asn, or His
  VARIANT 299: Xaa = Lys, Asp, Asn, or Arg
  VARIANT 301: Xaa = Thr, Gln, or Ser
  VARIANT 303: Xaa = Glu, or Val
  VARIANT 304: Xaa = Ile, Tyr, or Leu
  VARIANT 306: Xaa = Asp, Asn, Gly, or Pro
  VARIANT 307: Xaa = Phe, Gln, or Glu
  VARIANT 308: Xaa = Leu, or Ala
  VARIANT 309: Xaa = Ser, Ala, or Phe
  VARIANT 310: Xaa = Gly, Asp, Ala, or Leu
  VARIANT 311: Xaa = Ala, Leu, or Lys
  VARIANT 312: Xaa = Cys, or Leu
  VARIANT 313: Xaa = Asp, Lys, or Gln
  VARIANT 314: Xaa = Thr, or Gln
  VARIANT 315: Xaa = Leu, or Val
  VARIANT 316: Xaa = Thr, Val, or Glu
  VARIANT 317: Xaa = Gly, Glu, Ala, or Thr
  VARIANT 319: Xaa = Asp, or Ser
  VARIANT 322: Xaa = Gly, Tyr, or Phe
  VARIANT 324: Xaa = His, Asn, or Ala
  VARIANT 325: Xaa = Phe, or Leu
  VARIANT 326: Xaa = Tyr, Ser, or Asn
  VARIANT 328: Xaa = Ala, Met, Ser, or Glu
  VARIANT 329: Xaa = Val, Ile, or Leu
  VARIANT 331: Xaa = Pro, Glu, Asp, or Ser
  VARIANT 332: Xaa = Phe, Ser, Thr, or Gln
  VARIANT 333: Xaa = Phe, Leu, or Val
  VARIANT 334: Xaa = Gly, Ala, or Thr
  VARIANT 335: Xaa = Ser, Glu, or Ala
  VARIANT 336: Xaa = Cys, or Leu
  VARIANT 337: Xaa = Ser, Pro, or Val
  VARIANT 338: Xaa = Leu, Ser, Glu, or Trp
  VARIANT 340: Xaa = Glu, or Gln
  VARIANT 341: Xaa = Ser, Leu, Gln, or Asn
  VARIANT 342: Xaa = Leu, or Val
  VARIANT 343: Xaa = Ala, Asp, or Asn
  VARIANT 344: Xaa = Leu, or Ile
  VARIANT 345: Xaa = Ser, or Gly
  VARIANT 346: Xaa = Ser, or Asn
  VARIANT 348: Xaa = Asn, Thr, or Tyr
  VARIANT 349: Xaa = Phe, or Leu
  VARIANT 352: Xaa = Glu, Lys, Thr, or Asp
  VARIANT 353: Xaa = Leu, Ile, or Phe
  VARIANT 354: Xaa = Pro, or Leu
  VARIANT 355: Xaa = Met, Val, or Ser
  VARIANT 356: Xaa = Asp, Ser, or Thr
  VARIANT 357: Xaa = Thr, Leu, or Val
  VARIANT 358: Xaa = Leu, Cys, or Val
  VARIANT 359: Xaa = Leu, Gln, or Ser
  VARIANT 360: Xaa = Lys, or Asp
  VARIANT 361: Xaa = Met, Leu, Pro, or Ile
  VARIANT 362: Xaa = Arg, Ser, Asn, or Thr
  VARIANT 363: Xaa = Gly, Asn, Ser, or Arg
  VARIANT 364: Xaa = Leu, or Ile
  VARIANT 365: Xaa = Lys, His, or Thr
  VARIANT 366: Xaa = Val, Thr, Leu, or Tyr
  VARIANT 367: Xaa = Leu, or Met
  VARIANT 368: Xaa = Asp, Val, or Tyr
  VARIANT 369: Xaa = Leu, or Val
  VARIANT 370: Xaa = Ser, Gln, or Ala
  VARIANT 371: Xaa = Phe, or Asn
  VARIANT 373: Xaa = Glu, Lys, Tyr, or Asn
  VARIANT 374: Xaa = Phe, Leu, or Ile
  VARIANT 375: Xaa = Ser, Val, or Thr
  VARIANT 377: Xaa = Glu, Gly, or Ser
  VARIANT 378: Xaa = Leu, Ile, or Val
  VARIANT 380: Xaa = Glu, Asp, or Ile
  VARIANT 381: Xaa = Ser, or Ala
  VARIANT 382: Xaa = Leu, Phe, or Val
  VARIANT 383: Xaa = Thr, or Ser
  VARIANT 385: Xaa = Leu, or Cys
  VARIANT 386: Xaa = Ser, or Thr
  VARIANT 387: Xaa = Ala, or Pro
  VARIANT 388: Xaa = Ser, Lys, or Asn
  VARIANT 390: Xaa = Leu, Glu, Val, or Arg
  VARIANT 391: Xaa = Thr, Ser, or Val
  VARIANT 394: Xaa = Leu, or Met
  VARIANT 396: Xaa = Ser, or Leu
  VARIANT 398: Xaa = Asn, Tyr, or Gly
  VARIANT 399: Xaa = Phe, Leu, or Ile
  VARIANT 400: Xaa = Ser, Thr, or Asn
  VARIANT 402: Xaa = Pro, Ile, Ser, or Asn
  VARIANT 403: Xaa = Ile, or Val
  VARIANT 404: Xaa = Leu, or Pro
  VARIANT 405: Xaa = Pro, Ser, or Ala
  VARIANT 406: Xaa = Asn, Gly, or Ser
  VARIANT 407: Xaa = Leu, or Ile
  VARIANT 409: Xaa = Gln, or Lys
  VARIANT 410: Xaa = Asn, Asp, Gly, or Gln
  VARIANT 411: Xaa = Pro, Asp, or Ser
  VARIANT 412: Xaa = Lys, Met, Leu, or Ser
  VARIANT 413: Xaa = Asn, Gly, or Pro
  VARIANT 414: Xaa = Thr, Asn, or Val
  VARIANT 416: Xaa = Gln, Lys, or Glu
  VARIANT 417: Xaa = Glu, Val, Asp, or Lys
  VARIANT 419: Xaa = Tyr, Ile, or Leu
  VARIANT 420: Xaa = Leu, or Ile
  VARIANT 421: Xaa = Gln, Trp, or Ala
  VARIANT 422: Xaa = Asn, or Gln
  VARIANT 424: Xaa = Gly, Leu, Glu, or Tyr
  VARIANT 425: Xaa = Phe, or Leu
  VARIANT 426: Xaa = Thr, Lys, Glu, or Ser
  VARIANT 428: Xaa = Lys, Pro, Glu, or Thr
  VARIANT 429: Xaa = Ile, or Val
  VARIANT 431: Xaa = Pro, Asp, Ala, or Val
  VARIANT 432: Xaa = Thr, Ser, or Glu
  VARIANT 434: Xaa = Ser, or Gly
  VARIANT 435: Xaa = Asn, Arg, or Lys
  VARIANT 436: Xaa = Cys, or Ile
  VARIANT 437: Xaa = Ser, Gln, or Lys
  VARIANT 438: Xaa = Glu, Gln, Gly, or Ser
  VARIANT 440: Xaa = Val, Glu, or Lys
  VARIANT 441: Xaa = Ser, His, or Thr
  VARIANT 442: Xaa = Leu, or Ile
  VARIANT 443: Xaa = His, Asp, or Ile
  VARIANT 445: Xaa = Ser, or Asp
  VARIANT 446: Xaa = Phe, or Tyr
  VARIANT 448: Xaa = Tyr, Gly, or Glu
  VARIANT 450: Xaa = Ser, or Thr
  VARIANT 452: Xaa = Thr, Ser, or Pro
  VARIANT 455: Xaa = Ser, Pro, or Lys
  VARIANT 456: Xaa = Ser, Glu, or Asp
  VARIANT 457: Xaa = Leu, or Val
  VARIANT 458: Xaa = Gly, Ala, or Trp
  VARIANT 459: Xaa = Ser, Lys, or Met
  VARIANT 460: Xaa = Leu, or Cys
  VARIANT 461: Xaa = Ser, Thr, or Pro
  VARIANT 462: Xaa = Lys, or Asn
  VARIANT 464: Xaa = Arg, Lys, Asn, or Ser
  VARIANT 465: Xaa = Asp, or Trp
  VARIANT 466: Xaa = Leu, or Ile
  VARIANT 467: Xaa = Lys, Ile, Ser, or Val
  VARIANT 468: Xaa = Leu, or Met
  VARIANT 469: Xaa = Trp, or Ala
  VARIANT 470: Xaa = Leu, Ser, or Ala
  VARIANT 472: Xaa = Met, Gln, Arg, or Asn
  VARIANT 474: Xaa = Glu, Ser, or Thr
  VARIANT 476: Xaa = Glu, Pro, or Ser
  VARIANT 479: Xaa = Gln, or Ser
  VARIANT 480: Xaa = Glu, or Trp
  VARIANT 481: Xaa = Leu, or Gly
  VARIANT 482: Xaa = Met, Gly, or Val
  VARIANT 483: Xaa = Tyr, Lys, or Cys
  VARIANT 484: Xaa = Val, or Leu
  VARIANT 485: Xaa = Lys, Gln, or Ser
  VARIANT 486: Xaa = Thr, Ala, Tyr, or Lys
  VARIANT 488: Xaa = Glu, or Ala
  VARIANT 489: Xaa = Thr, Asn, or Ile
  VARIANT 490: Xaa = Leu, or Ile
  VARIANT 491: Xaa = Ile, or Lys
  VARIANT 493: Xaa = Asp, Ser, or Asn
  VARIANT 494: Xaa = Phe, or Asn
  VARIANT 496: Xaa = Asp, Ser, or Leu
  VARIANT 497: Xaa = Leu, or Phe
  VARIANT 498: Xaa = Thr, or Ser
  VARIANT 500: Xaa = Glu, Pro, or Ser
  VARIANT 503: Xaa = Ser, Ala, Pro, or Gln
  VARIANT 504: Xaa = Gly, Ser, or Glu
  VARIANT 505: Xaa = Leu, or Ile
  VARIANT 506: Xaa = Ser, or Gly
  VARIANT 507: Xaa = Asn, Asp, or Arg
  VARIANT 509: Xaa = Thr, or Gln
  VARIANT 510: Xaa = Asn, Lys, or Ser
  VARIANT 511: Xaa = Leu, or Met
  VARIANT 512: Xaa = Asn, Val, or Ile
  VARIANT 514: Xaa = Ile, or Leu
  VARIANT 515: Xaa = Ser, or Asp
  VARIANT 517: Xaa = Ser, or Asn
  VARIANT 518: Xaa = Asn, or Ser
  VARIANT 520: Xaa = Arg, or Gln
  VARIANT 522: Xaa = Thr, Ser, or Asn
  VARIANT 524: Xaa = Glu, Ser, or Lys
  VARIANT 527: Xaa = Lys, Ala, or Thr
  VARIANT 528: Xaa = Trp, Ser, or Gly
  VARIANT 529: Xaa = Ile, or Leu
  VARIANT 531: Xaa = Arg, or Asn
  VARIANT 533: Xaa = Glu, or Ser
  VARIANT 534: Xaa = Asn, or Lys
  VARIANT 539: Xaa = Lys, or Gln
  VARIANT 541: Xaa = Ser, or Gly
  VARIANT 545: Xaa = Phe, Ile, or Leu
  VARIANT 549: Xaa = Ile, or Val
  VARIANT 551: Xaa = Ala, or Arg
  VARIANT 552: Xaa = Glu, or Gln
  VARIANT 555: Xaa = Asp, or Asn
  VARIANT 557: Xaa = Arg, Gln, or Lys
  VARIANT 566: Xaa = Thr, or Ser
  VARIANT 568: Xaa = Leu, Phe, or Asn
  VARIANT 569: Xaa = Phe, or Leu
  VARIANT 570: Xaa = Asn, or Thr
  VARIANT 572: Xaa = Thr, Ser, or Asp
  VARIANT 573: Xaa = Ile, or Leu
  VARIANT 575: Xaa = Ala, Pro, or Gly
  VARIANT 576: Xaa = Ala, Pro, or Glu
  VARIANT 577: Xaa = Met, or Leu
  VARIANT 578: Xaa = Phe, or Ala
  VARIANT 579: Xaa = Lys, or Ser
  VARIANT 581: Xaa = Ser, or Ala
  VARIANT 583: Xaa = Lys, Asn, or Leu
  VARIANT 584: Xaa = Ile, Met, or Val
  VARIANT 585: Xaa = Ala, Asn, or Met
  VARIANT 586: Xaa = Ala, Val, or Pro
  VARIANT 587: Xaa = Asn, Ala, or Gly
  VARIANT 588: Xaa = Phe, Leu, or Ser
  VARIANT 589: Xaa = Ile, Leu, or Val
  VARIANT 590: Xaa = Ala, Thr, Val, or Ser
  VARIANT 592: Xaa = Lys, or Arg
  VARIANT 593: Xaa = Arg, Pro, or Gln
  VARIANT 594: Xaa = Tyr, or Phe
  VARIANT 595: Xaa = Val, or Ala
  VARIANT 596: Xaa = Tyr, or Phe
  VARIANT 597: Xaa = Ile, Leu, or Val
  VARIANT 598: Xaa = Lys, or Arg
  VARIANT 600: Xaa = Asp, or Glu
  VARIANT 601: Xaa = Gly, or Glu
  VARIANT 602: Xaa = Met, or Leu
  VARIANT 603: Xaa = Lys, Ser, or Gly
  VARIANT 604: Xaa = Lys, Ser, or Thr
  VARIANT 605: Xaa = Glu, or Asp
  VARIANT 607: Xaa = His, or Arg
  VARIANT 609: Xaa = Ala, or Lys
  VARIANT 611: Xaa = Asn, Ser, or Gly
  VARIANT 613: Xaa = Leu, or Val
  VARIANT 616: Xaa = Gln, Gly, Thr, or Glu
  VARIANT 617: Xaa = Gly, or Ser
  VARIANT 620: Xaa = Ser, Gln, Pro, or Ala
  VARIANT 621: Xaa = Glu, or Asp
  VARIANT 622: Xaa = Gln, Asp, or Arg
  VARIANT 624: Xaa = Asn, Asp, Ser, or Glu
  VARIANT 626: Xaa = Leu, Ile, Met, or Phe
  VARIANT 627: Xaa = Ser, or Pro
  VARIANT 628: Xaa = Thr, Ser, or Met
  VARIANT 629: Xaa = Arg, Lys, or Val
  VARIANT 630: Xaa = Asn, His, or Lys
  VARIANT 631: Xaa = Pro, Leu, or Ser
  VARIANT 633: Xaa = Asn, or Pro
  VARIANT 634: Xaa = Ile, Phe, or Ala
  VARIANT 638: Xaa = Val, Met, or Ile
  VARIANT 640: Xaa = Gly, Arg, Val, or Ser
  VARIANT 642: Xaa = His, Ile, Ser, or Met
  VARIANT 644: Xaa = Ser, Gln, Glu, or Met
  VARIANT 645: Xaa = Pro, or Tyr
  VARIANT 648: Xaa = Asp, Asn, or Ser
  VARIANT 649: Xaa = Asn, His, Lys, or Ala
  VARIANT 654: Xaa = Met, or Ile
  VARIANT 655: Xaa = Phe, or Tyr
  VARIANT 656: Xaa = Leu, or Phe
  VARIANT 658: Xaa = Met, Leu, or Ile
  VARIANT 662: Xaa = Met, Lys, Gln, or Ala
  VARIANT 663: Xaa = Leu, or Val
  VARIANT 664: Xaa = Ser, Glu, or Asp
  VARIANT 665: Xaa = Gly, or Ser
  VARIANT 666: Xaa = Tyr, Ser, Ala, or Leu
  VARIANT 669: Xaa = Lys, Gly, or Pro
  VARIANT 670: Xaa = Glu, or Gly
  VARIANT 671: Xaa = Ile, Leu, or Tyr
  VARIANT 673: Xaa = Ser, Ala, Asp, or Asn
  VARIANT 675: Xaa = Pro, Tyr, Phe, or Gly
  VARIANT 678: Xaa = Phe, Ser, Met, or Gln
  VARIANT 679: Xaa = Ile, or Val
  VARIANT 680: Xaa = Leu, or Met
  VARIANT 686: Xaa = Asp, Leu, or Arg
  VARIANT 687: Xaa = Ile, or Leu
  VARIANT 688: Xaa = Ser, or Thr
  VARIANT 690: Xaa = Ser, Met, Thr, or Asn
  VARIANT 693: Xaa = Asp, Gln, or Ser
  VARIANT 694: Xaa = Glu, Gln, Arg, or Ser
  VARIANT 695: Xaa = Val, or Leu
  VARIANT 696: Xaa = Gly, or Ala
  VARIANT 697: Xaa = Asp, Gly, or Glu
  VARIANT 698: Xaa = Leu, or Ala
  VARIANT 699: Xaa = Arg, or Lys
  VARIANT 700: Xaa = Gly, Asn, Lys, or Ala
  VARIANT 701: Xaa = Leu, Val, or Ile
  VARIANT 702: Xaa = Asn, Ala, or Gly
  VARIANT 703: Xaa = Ile, or Val
  VARIANT 708: Xaa = Ser, Tyr, or His
  VARIANT 710: Xaa = Lys, Arg, Gln, or Asp
  VARIANT 711: Xaa = Leu, or Phe
  VARIANT 712: Xaa = Asp, Asn, Glu, or Gln
  VARIANT 714: Xaa = Arg, Thr, Pro, or Tyr
  VARIANT 715: Xaa = Ile, or Leu
  VARIANT 717: Xaa = Gln, Asn, or Gly
  VARIANT 718: Xaa = Ala, or Ser
  VARIANT 719: Xaa = Met, Leu, or Phe
  VARIANT 720: Xaa = Ser, Thr, or Gly
  VARIANT 721: Xaa = Ala, or Ser
  VARIANT 723: Xaa = Thr, or Ser
  VARIANT 724: Xaa = Met, Leu, or Phe
  VARIANT 726: Xaa = Thr, Gly, or Ser
  VARIANT 727: Xaa = Glu, or Asp
  VARIANT 728: Xaa = Ile, or Leu
  VARIANT 729: Xaa = Asp, or Asn
  VARIANT 730: Xaa = Leu, or Val
  VARIANT 734: Xaa = Asn, or Gln
  VARIANT 736: Xaa = Ser, Asn, or Thr
  VARIANT 738: Xaa = Pro, Met, or Thr
  VARIANT 741: Xaa = Glu, or Phe
  VARIANT 742: Xaa = Met, Ser, Leu, or Gly
  VARIANT 743: Xaa = Gly, or Ala
  VARIANT 744: Xaa = Gln, Pro, or Ser
  VARIANT 745: Xaa = Phe, or Leu
  VARIANT 746: Xaa = Glu, Asp, Ala, or Thr
  VARIANT 750: Xaa = Pro, Asp, Lys, or Val
  VARIANT 751: Xaa = Ala, Tyr, or Ser
  VARIANT 752: Xaa = Lys, Arg, or Gln
  VARIANT 753: Xaa = Phe, or Tyr
  VARIANT 754: Xaa = Leu, Ala, or Glu
  VARIANT 757: Xaa = Pro, Thr, or Ser
  VARIANT 758: Xaa = Gly, or Ser
  VARIANT 762: Xaa = Tyr, Phe, or Val
  VARIANT 765: Xaa = Pro, or Arg
  VARIANT 766: Xaa = Arg, or Pro
  VARIANT 768: Xaa = Asp, or Ser
  VARIANT 769: Xaa = Pro, Ser, or His
  VARIANT 770: Xaa = Ser, or Gly
  VARIANT 771: Xaa = Asn, Pro, or Ser
  VARIANT 772: Xaa = Ala, Lys, or Pro
  VARIANT 773: Xaa = Asp, Ser, Arg, or Pro
  VARIANT 774: Xaa = Gly, Asp, Ser, or Arg
  VARIANT 775: Xaa = Tyr, Ala, Ser, or Arg
  VARIANT 776: Xaa = Ala, Asn, or Pro
  VARIANT 777: Xaa = His, Gln, Asp, or Ile
  VARIANT 778: Xaa = His, or Thr
  VARIANT 779: Xaa = Gln, or Ser
  VARIANT 780: Xaa = Arg, Lys, or Ser
  VARIANT 781: Xaa = Ser, or Val
  VARIANT 783: Xaa = Gly, or Ala
  VARIANT 784: Xaa = Arg, or Lys
  VARIANT 785: Xaa = Arg, or Lys
  VARIANT 786: Xaa = Pro, or Gln
  VARIANT 787: Xaa = Ala, or Gln
  VARIANT 788: Xaa = Ser, or Thr
  VARIANT 789: Xaa = Leu, or Met
  VARIANT 791: Xaa = Gly, Ser, or Thr
  VARIANT 792: Xaa = Ser, or Ala
  VARIANT 793: Xaa = Val, or Ile
  VARIANT 794: Xaa = Ala, or Ile
  VARIANT 795: Xaa = Met, or Ala
  VARIANT 797: Xaa = Leu, or Ile
  VARIANT 798: Xaa = Leu, or Ala
  VARIANT 801: Xaa = Phe, or Leu
  VARIANT 802: Xaa = Val, Phe, or Met
  VARIANT 804: Xaa = Ile, or Leu
  VARIANT 805: Xaa = Phe, Ile, or Val
  VARIANT 806: Xaa = Gly, Val, or Met
  VARIANT 807: Xaa = Leu, or Ile
  VARIANT 808: Xaa = Ile, or Phe
  VARIANT 809: Xaa = Leu, Ile, or Met
  VARIANT 810: Xaa = Val, or Ala
  VARIANT 811: Xaa = Gly, Ala, Ile, or Leu
  VARIANT 812: Xaa = Arg, Ile, Gly, or Tyr
  VARIANT 813: Xaa = Glu, Ser, or Arg
  VARIANT 814: Xaa = Met, Thr, Lys, or Val
  VARIANT 815: Xaa = Arg, or Lys
  VARIANT 816: Xaa = Lys, or Arg
  VARIANT 818: Xaa = Arg, Leu, or Val
  VARIANT 819: Xaa = Arg, Lys, or Gln
  VARIANT 820: Xaa = Lys, or Asn
  VARIANT 821: Xaa = Lys, or Glu
  VARIANT 823: Xaa = Ala, or Leu
  VARIANT 824: Xaa = Glu, Ala, Ser, or Lys
  VARIANT 825: Xaa = Leu, Thr, or Arg
  VARIANT 826: Xaa = Glu, or Asp
  VARIANT 827: Xaa = Met, Ala, Ile, or Lys
  VARIANT 829: Xaa = Ala, Met, or Ile
  VARIANT 830: Xaa = Glu, or Asp
  VARIANT 831: Xaa = Gly, or Ser
  VARIANT 832: Xaa = His, Arg, or Leu
  VARIANT 833: Xaa = Gly, Ser, or Pro
  VARIANT 834: Xaa = Asn, His, or Thr
  VARIANT 836: Xaa = Gly, or Ala
  VARIANT 840: Xaa = Ala, or Thr
  VARIANT 841: Xaa = Asn, or Met
  VARIANT 842: Xaa = Asn, or Ser
  VARIANT 843: Xaa = Thr, Ala, Ser, or Cys
  VARIANT 844: Xaa = Asn, Asp, or Ser
  VARIANT 846: Xaa = Lys, or Arg
  VARIANT 847: Xaa = Leu, or Phe
  VARIANT 848: Xaa = Thr, or Ser
  VARIANT 849: Xaa = Gly, or Ser
  VARIANT 850: Xaa = Val, Ala, or Thr
  VARIANT 851: Xaa = Lys, Arg, Asn, or Pro
  VARIANT 853: Xaa = Ala, Leu, or Pro
  VARIANT 858: Xaa = Leu, or Val
  VARIANT 860: Xaa = Ala, or Thr
  VARIANT 866: Xaa = Arg, or Gln
  VARIANT 867: Xaa = Lys, or Asn
  VARIANT 870: Xaa = Phe, or Leu
  VARIANT 872: Xaa = Asp, or His
  VARIANT 874: Xaa = Leu, or Val
  VARIANT 875: Xaa = Gln, or Glu
  VARIANT 881: Xaa = His, or Ser
  VARIANT 882: Xaa = Asn, Ile, or Ala
  VARIANT 883: Xaa = Asp, Ala, or Glu
  VARIANT 884: Xaa = Ser, Cys, or Thr
  VARIANT 885: Xaa = Leu, Gln, or Met
  VARIANT 886: Xaa = Ile, or Val
  VARIANT 893: Xaa = Asp, or Glu
  VARIANT 898: Xaa = Ile, or Gln
  VARIANT 900: Xaa = Lys, or Arg
  VARIANT 903: Xaa = Ser, or Lys
  VARIANT 904: Xaa = Ala, or Val
  VARIANT 912: Xaa = His, or Arg
  VARIANT 913: Xaa = Val, or Ile
  VARIANT 914: Xaa = Ser, or Thr
  VARIANT 922: Xaa = Met, or Thr
  VARIANT 945: Xaa = Val, or Ala
  VARIANT 947: Xaa = Asp, or Glu
  VARIANT 954: Xaa = Glu, or Asp
  VARIANT 955: Xaa = Phe, or Tyr
  VARIANT 958: Xaa = Tyr, Phe, or Trp
  VARIANT 963: Xaa = Asp, or Thr
  VARIANT 967: Xaa = Asp, or Glu
  VARIANT 968: Xaa = Pro, Arg, or Ser
  VARIANT 971: Xaa = Ala, Thr, Ile, or Gly
  VARIANT 973: Xaa = Val, Ile, or Lys
  VARIANT 974: Xaa = Lys, or Phe
  VARIANT 978: Xaa = Ser, Pro, Glu, or Thr
  VARIANT 979: Xaa = Thr, or Ala
  VARIANT 981: Xaa = Arg, or Lys
  VARIANT 985: Xaa = Ile, or Val
  VARIANT 987: Xaa = Ser, or Ala
  VARIANT 997: Xaa = Asn, or Ser
  VARIANT 999: Xaa = Ser, or Ile
  VARIANT 1014: Xaa = Leu, or Ile
  VARIANT 1017: Xaa = Asn, Gln, or Asp
  VARIANT 1018: Xaa = Leu, or Phe
  VARIANT 1031: Xaa = Met, or Val
  VARIANT 1033: Xaa = Ala, or Val
  VARIANT 1034: Xaa = Met, Val, or Leu
  VARIANT 1061: Xaa = Ser, or Thr
  VARIANT 1062: Xaa = Thr, or Ala
  VARIANT 1072: Xaa = Val, or Ile
  VARIANT 1078: Xaa = Thr, or Ser
  VARIANT 1081: Xaa = Arg, Gln, Pro, or Lys
  VARIANT 1083: Xaa = Thr, or Ile
  VARIANT 1085: Xaa = Ser, or Pro
  VARIANT 1086: Xaa = Pro, Ala, or Gly
  VARIANT 1087: Xaa = Asp, or Glu
  VARIANT 1098: Xaa = Val, or Ala
  VARIANT 1099: Xaa = Gln, or Leu
  VARIANT 1100: Xaa = His, or Leu
  VARIANT 1101: Xaa = Ala, Thr, or Tyr
  VARIANT 1102: Xaa = Lys, or Arg
  VARIANT 1103: Xaa = Leu, Gly, or Glu
  VARIANT 1104: Xaa = Arg, or Lys
  VARIANT 1105: Xaa = Ile, or Ser
  VARIANT 1106: Xaa = Ser, or Thr
  VARIANT 1107: Xaa = Asp, or Glu
  VARIANT 1108: Xaa = Val, or Ile
  VARIANT 1109: Xaa = Phe, or Leu
  VARIANT 1111: Xaa = Pro, or Arg
  VARIANT 1114: Xaa = Met, Leu, or Val
  VARIANT 1115: Xaa = Lys, or Thr
  VARIANT 1117: Xaa = Asp, or Lys
  VARIANT 1118: Xaa = Pro, Ala, or Ser
  VARIANT 1119: Xaa = Ala, Ser, or Gly
  VARIANT 1120: Xaa = Leu, Ile, or Val
  VARIANT 1121: Xaa = Glu, or Asp
  VARIANT 1122: Xaa = Ile, Leu, or Ala
  VARIANT 1125: Xaa = Leu, or Phe
  VARIANT 1126: Xaa = Gln, Glu, or His
  VARIANT 1127: Xaa = His, or Tyr
  VARIANT 1130: Xaa = Val, or Ile
  VARIANT 1132: Xaa = Val, Cys, or Ser
  VARIANT 1133: Xaa = Ala, or Gln
  VARIANT 1139: Xaa = Ala, His, or Pro
  VARIANT 1140: Xaa = Trp, Ser, or Phe
  VARIANT 1141: Xaa = Arg, or Lys
  VARIANT 1146: Xaa = Val, Ile, or Leu
  VARIANT 1147: Xaa = Gln, or Lys
  VARIANT 1155: Xaa = Ile, or Leu
  VARIANT 1156: Xaa = Gln, or Lys
  VARIANT 1158: Xaa = Gly, or Asp
  VARIANT 1159: Xaa = Ser, or Thr
  VARIANT 1160: Xaa = Gly, Thr, or Glu
  VARIANT 1161: Xaa = Ile, Met, Val, or Glu
  VARIANT 1164: Xaa = Gln, Thr, or Lys
  VARIANT 1165: Xaa = Ser, or Thr
  VARIANT 1166: Xaa = Thr, or Ser
  VARIANT 1167: Xaa = Ile, or Ala
  VARIANT 1168: Xaa = Arg, or Gly
  VARIANT 1169: Xaa = Ser, or Ala
  VARIANT 1171: Xaa = Glu, or Asp
  VARIANT 1172: Xaa = Asp, or Glu
  VARIANT 1173: Xaa = Gly, or Val
  VARIANT 1174: Xaa = Gly, or Asn
  VARIANT 1175: Xaa = Phe, or Tyr
  VARIANT 1176: Xaa = Ser, or Gly
  VARIANT 1177: Xaa = Thr, or Gly
  VARIANT 1178: Xaa = Ile, or Val
  VARIANT 1180: Xaa = Met, or Val
  VARIANT 1181: Xaa = Val, or Leu
  VARIANT 1184: Xaa = Ser, or Pro
  VARIANT 1185: Xaa = Ile, or Leu
  VARIANT 1186: Xaa = Lys, or Arg
  VARIANT 1188: Xaa = Val, or Ala
  VARIANT 1189: Xaa = Pro, or Lys
  VARIANT 1191: Xaa = Gly, or Glu
FXXXXLSXXXLFFXXXXXXXXXASPXXSLYXXXXQLXXFXXXXPXXXXLXXWXXXXXXCXXXGXXCXXXXXXXXXLXXXXXXXXXXXVXXXLXXLXXXXXLXLXXXXXXXXXXXXXXXXXLXXXDLXXNXXXXXXXXXXXXXXCXXLXXXNXSXXXXXXXXXXXXXXXXXXLXXXDXSXNXXXXXXXXXXXXXXXXXXXXXXXXXXNXXXGXXXXXXXXNLXXXXXSXNNFSTXXPXXXDCSXLQXLDXSXXXXXGXXXXXXXXCXXLXXLNXXXNXXXGXXPXXXXXXLXXLXLXXNXFXGXXPXXXXXXXXXXXXLXLSXNXXXGXXPXXXXXXXXLXXXXXXXNXXSGXXXXXXXXXXXXXXXXXXXXNXXXGXXPXXXXNXXXXLXXLDXSXNXXXGXXXXXXCXXXXXXLXXLXXXXNXXXGXXPXXLXXXXXLXXXXLXXNXLXGXIPXXXXXXXXLXXXXXXXNXLXGXIPXXXXXXXXLXXXXLXXNXXXGXIPXXXXXCXXXXWXXLXXNXLXGXIPXXXGXLXXLAILXLXNNSXSGNXPXXLGXCXSLIWLDLNXNXXXGXXPXXXXXQXGXXXXXXXXGXXXXXXXNXXXXXXCXGXGXLXEFXXIRXXXLXRXXXXXXCXXTSRXYXGXTXXTFXXNGSMXXXDXSYNXXXXXIPXXXGXMXYLXXXNLGHNXXXGXIPXXXXXXXXXXXLDLSXNXXXGXXPXXXXXLXXLXXXXXSNNXLXGXIPXXXXXXTFPXXXXXNNXXLCGXPLXXCXXXXXXXXXXXXXXHXXXXXXXAXXXXXGXXFSXXCXXXXXXXXXXXXXRXXXXEXXXXXYXXXXXXSXDRTXXXXXWXXXXXXEXLSINXAXFEKPLXXLTXAXLXXATNGFXXXXXXGSGGFGXVYKAXLXDGXXVAIKKLIXXXGQGDREFXAEMETIGKIKHRNLVPLLGYCKXGXERLLVYXXMKXGSLEXVLHXXKKXGXXLNWXXRXKIAXGXARGLAFLHHXCXPHIIHRDMKSSNVLXDEXXEARVSDFGMARLXSXXDTHLSVSTLAGTPGYVPPEYYQSFRCXXKGDVYSYGVXLLELLXGKXPXDXXXFGDNNLVGWXKXXXXXXXXXXXDXELXXEXXXXXXELXXXLKXAXXCLDDRXXXRPTMXXVMAMFKEXXAXXXXDSXXXXXXIXXXXXXXXEXXDMXXXEXXEXK

SEQ ID NO: 260 - protein, 1234 aa, Artificial Sequence
  consensus sequence
  VARIANT 2: Xaa = Ser, or Asn
  VARIANT 3: Xaa = Ser, or Gln
  VARIANT 4: Xaa = Phe, or His
  VARIANT 5: Xaa = Phe, or Pro
  VARIANT 8, 47, 79, 82, 89, 106, 138, 146, 166, 193, 200,217, 222, 270, 284, 295, 341, 355, 368, 370, 391,394, 396, 405, 421, 430, 434, 448, 457, 470, 485,494, 496, 512, 520, 535, 541, 544, 607, 614, 619,627, 643, 668, 684, 688, 693, 709, 710, 717, 725,731, 733, 745, 758, 760, 820, 824, 828, 835, 838,840, 893, 909, 921, 948, 1022, 1051, 1068, 1071,1109, 1147, 1153, 1169, 1185, 1194, 1222, 1223, 1227: Xaa = Ile, Leu, Val, or Met
  VARIANT 9: Xaa = Thr, or Asn
  VARIANT 10: Xaa = Thr, or Lys
  VARIANT 14: Xaa = Phe, or Val
  VARIANT 15: Xaa = Ser, or Leu
  VARIANT 16-17, 19, 21: Xaa = Phe, or Leu
  VARIANT 18: Xaa = Ser, or Ile
  VARIANT 20: Xaa = Ser, or Phe
  VARIANT 22, 30-32, 41, 45, 48, 50-53, 55-56, 58-60, 62-65,67, 69, 74, 76-77, 80, 85-88, 90-92, 94, 96-97, 99,102, 104-105, 108, 110, 112, 114-116, 120, 122-124,126-130, 133-134, 136-137, 142, 144-145, 149-155,158-159, 165, 168, 170, 172-173, 175-177, 180-188,191-192, 197, 199, 202-207, 209-210, 212, 214-216,218-219, 221, 223-224, 226-227, 230-238, 240-269,275-282, 286, 288-289, 291, 292, 297, 299, 303-304,306-314, 317-318, 320, 322-323, 325, 327, 330, 332-333,335-337, 339, 342-343, 348, 350, 352, 354, 357-359,361, 363-364, 367, 369, 374, 378-379, 381-385, 387-390,392-393, 395, 397, 400-402, 404, 407, 409, 413-415,417-418, 425-427, 429, 432-433, 435-442, 444-445,447, 449, 452, 454, 456, 459-460, 463, 465-466, 468-469,471, 476, 480, 483-484, 486-487, 489, 492, 495, 498,500, 502, 504, 507, 510-511, 513-516, 519, 523, 526,530, 533-534, 537, 540, 542, 552, 554, 557-606, 613,615-618, 620, 623, 632-634, 641, 646, 650, 652, 654,656, 658-661, 664, 666, 670, 672, 674, 678-679, 692,694, 696, 699, 701, 703, 705, 708, 716, 720, 723-724,727, 730, 732, 738, 740, 742, 744, 747, 749, 754, 766,768, 772, 774, 776, 780-782, 784, 787, 792, 796, 799-800,802-808, 811, 814, 817, 833, 836-837, 842-845, 848-850,855-858, 860, 862, 865-867, 870-874, 876-877, 880-881,885-888, 917-920, 1003-1005, 1008, 1010, 1015, 1054,1118, 1123, 1127, 1139, 1141, 1144, 1157, 1159, 1161,1165, 1171, 1178-1179, 1199-1200, 1203, 1206-1208,1212, 1219-1221: Xaa = any amino acid
  VARIANT 23: Xaa = Gln, or Pro
  VARIANT 27, 61, 72, 81, 98, 118-119, 121, 125, 132, 141,157, 161, 189, 201, 228, 272, 283, 296, 360, 371,408, 410, 462, 478, 528, 536, 611, 647, 695, 718,726, 748, 750-751, 753, 756, 773, 788, 801, 819,822-823, 864, 869, 883-884, 895, 949, 1016, 1024,1098-1099, 1115, 1145, 1158, 1198, 1204, 1205, 1211,1218: Xaa = Thr, Gly, or Ala
  VARIANT 28: Xaa = Gln, or Ala
  VARIANT 35, 44, 78, 622, 628, 637, 729, 815-816, 846-847,879, 935, 947, 1018, 1140, 1142, 1180, 1228: Xaa = His, Lys, or Arg
  VARIANT 36, 630, 635, 651, 757, 859, 863, 928, 982, 989,1002, 1124, 1146, 1160, 1213-1214: Xaa = Glu, or Asp
  VARIANT 37: Xaa = Ile, or Ser
  VARIANT 38: Xaa = His, or Gln
  VARIANT 42: Xaa = Ser, or Glu
  VARIANT 46: Xaa = Val, or Ala
  VARIANT 68, 474, 624, 626, 685, 783, 990, 993, 1217: Xaa = Phe, Tyr, or Trp
  VARIANT 71: Xaa = Val, or Ala
  VARIANT 75: Xaa = Asp, or Asn
  VARIANT 83: Xaa = Asp, or Ser
  VARIANT 93: Xaa = Phe, or Leu
  VARIANT 95: Xaa = Ala, or Leu
  VARIANT 101: Xaa = Leu, or Thr
  VARIANT 107: Xaa = Glu, or Gln
  VARIANT 113: Xaa = Asn, or Gly
  VARIANT 117: Xaa = Asn, or Ser
  VARIANT 131: Xaa = Cys, or Ser
  VARIANT 147: Xaa = Ser, or Arg
  VARIANT 148: Xaa = Gly, or Asp
  VARIANT 156: Xaa = Leu, or Phe
  VARIANT 162: Xaa = Gly, or Asn
  VARIANT 164: Xaa = Lys, or Val
  VARIANT 171: Xaa = Asn, or Asp
  VARIANT 174: Xaa = Leu, or Gly
  VARIANT 178: Xaa = Gly, or Val
  VARIANT 179: Xaa = Lys, or Gly
  VARIANT 195: Xaa = Leu, or Phe
  VARIANT 208: Xaa = Trp, or Ser
  VARIANT 211: Xaa = Ser, or Asp
  VARIANT 213: Xaa = Gly, or Phe
  VARIANT 220: Xaa = Leu, or Phe
  VARIANT 239: Xaa = Cys, or Phe
  VARIANT 273: Xaa = Asn, or Val
  VARIANT 274: Xaa = Lys, or Leu
  VARIANT 285: Xaa = Ser, or Pro
  VARIANT 300: Xaa = Phe, or Leu
  VARIANT 301: Xaa = Val, or Ala
  VARIANT 315: Xaa = Ser, or Asn
  VARIANT 329: Xaa = Glu, or Val
  VARIANT 334: Xaa = Leu, or Ala
  VARIANT 338: Xaa = Cys, or Leu
  VARIANT 340: Xaa = Thr, or Gln
  VARIANT 345: Xaa = Asp, or Ser
  VARIANT 351: Xaa = Phe, or Leu
  VARIANT 362: Xaa = Cys, or Leu
  VARIANT 366: Xaa = Glu, or Gln
  VARIANT 372: Xaa = Ser, or Asn
  VARIANT 375: Xaa = Phe, or Leu
  VARIANT 380: Xaa = Pro, or Leu
  VARIANT 386: Xaa = Lys, or Asp
  VARIANT 398: Xaa = Phe, or Asn
  VARIANT 412: Xaa = Leu, or Cys
  VARIANT 423: Xaa = Ser, or Leu
  VARIANT 431: Xaa = Leu, or Pro
  VARIANT 450, 764: Xaa = Asn, or Gln
  VARIANT 453: Xaa = Phe, or Leu
  VARIANT 464: Xaa = Cys, or Ile
  VARIANT 473: Xaa = Ser, or Asp
  VARIANT 488: Xaa = Leu, or Cys
  VARIANT 490: Xaa = Lys, or Asn
  VARIANT 493: Xaa = Asp, or Trp
  VARIANT 497: Xaa = Trp, or Ala
  VARIANT 508: Xaa = Glu, or Trp
  VARIANT 509: Xaa = Leu, or Gly
  VARIANT 518: Xaa = Glu, or Ala
  VARIANT 521: Xaa = Ile, or Lys
  VARIANT 524: Xaa = Phe, or Asn
  VARIANT 527: Xaa = Leu, or Phe
  VARIANT 539: Xaa = Thr, or Gln
  VARIANT 545: Xaa = Ser, or Asp
  VARIANT 547: Xaa = Ser, or Asn
  VARIANT 548: Xaa = Asn, or Ser
  VARIANT 550: Xaa = Arg, or Gln
  VARIANT 608: Xaa = Phe, or Ala
  VARIANT 609: Xaa = Lys, or Ser
  VARIANT 625: Xaa = Val, or Ala
  VARIANT 631: Xaa = Gly, or Glu
  VARIANT 639: Xaa = Ala, or Lys
  VARIANT 657: Xaa = Ser, or Pro
  VARIANT 663: Xaa = Asn, or Pro
  VARIANT 675: Xaa = Pro, or Tyr
  VARIANT 686: Xaa = Leu, or Phe
  VARIANT 700: Xaa = Glu, or Gly
  VARIANT 728: Xaa = Leu, or Ala
  VARIANT 741: Xaa = Leu, or Phe
  VARIANT 759: Xaa = Asp, or Asn
  VARIANT 771: Xaa = Glu, or Phe
  VARIANT 775: Xaa = Phe, or Leu
  VARIANT 795: Xaa = Pro, or Arg
  VARIANT 797: Xaa = Arg, or Pro
  VARIANT 809: Xaa = His, or Thr
  VARIANT 810: Xaa = Gln, or Ser
  VARIANT 812: Xaa = Ser, or Val
  VARIANT 818: Xaa = Ala, or Gln
  VARIANT 825: Xaa = Ala, or Ile
  VARIANT 826: Xaa = Met, or Ala
  VARIANT 829: Xaa = Leu, or Ala
  VARIANT 832: Xaa = Phe, or Leu
  VARIANT 839: Xaa = Ile, or Phe
  VARIANT 841: Xaa = Val, or Ala
  VARIANT 851: Xaa = Lys, or Asn
  VARIANT 852: Xaa = Lys, or Glu
  VARIANT 854: Xaa = Ala, or Leu
  VARIANT 875: Xaa = Asn, or Ser
  VARIANT 882: Xaa = Leu, or Phe
  VARIANT 901: Xaa = Arg, or Gln
  VARIANT 902: Xaa = Lys, or Asn
  VARIANT 905: Xaa = Phe, or Leu
  VARIANT 907: Xaa = Asp, or His
  VARIANT 910: Xaa = Gln, or Glu
  VARIANT 916: Xaa = His, or Ser
  VARIANT 933: Xaa = Ile, or Gln
  VARIANT 938: Xaa = Ser, or Lys
  VARIANT 939: Xaa = Ala, or Val
  VARIANT 957: Xaa = Met, or Thr
  VARIANT 980: Xaa = Val, or Ala
  VARIANT 998: Xaa = Asp, or Thr
  VARIANT 1011: Xaa = Lys, or Phe
  VARIANT 1034: Xaa = Asn, or Ser
  VARIANT 1036: Xaa = Ser, or Ile
  VARIANT 1055: Xaa = Leu, or Phe
  VARIANT 1070: Xaa = Ala, or Val
  VARIANT 1120: Xaa = Thr, or Ile
  VARIANT 1122: Xaa = Ser, or Pro
  VARIANT 1135: Xaa = Val, or Ala
  VARIANT 1137: Xaa = Gln, or Leu
  VARIANT 1138: Xaa = His, or Leu
  VARIANT 1143: Xaa = Ile, or Ser
  VARIANT 1148: Xaa = Phe, or Leu
  VARIANT 1150: Xaa = Pro, or Arg
  VARIANT 1154: Xaa = Lys, or Thr
  VARIANT 1156: Xaa = Asp, or Lys
  VARIANT 1164: Xaa = Leu, or Phe
  VARIANT 1166: Xaa = His, or Tyr
  VARIANT 1172: Xaa = Ala, or Gln
  VARIANT 1186: Xaa = Gln, or Lys
  VARIANT 1195: Xaa = Gln, or Lys
  VARIANT 1197: Xaa = Gly, or Asp
  VARIANT 1209: Xaa = Ile, or Ala
  VARIANT 1210: Xaa = Arg, or Gly
  VARIANT 1215: Xaa = Gly, or Val
  VARIANT 1216: Xaa = Gly, or Asn
  VARIANT 1226: Xaa = Ser, or Pro
  VARIANT 1230: Xaa = Val, or Ala
  VARIANT 1231: Xaa = Pro, or Lys
  VARIANT 1233: Xaa = Gly, or Glu
FXXXXLSXXXLFFXXXXXXXXXXASPXXSXXXLYXXXXQLXXFXXXXXPXXXXLXXWXXXXXXXXCXXXGXXCXXXXXXXXXXLXXXXXXXXXXXXXXXLXXLXXXXXLXLXXXXXXXXXXXXXXXXXXXXXXXLXXXDLXXNXXXXXXXXXXXXXXXXCXXLXXXNXSXXXXXXXXXXXXXXXXXXXXLXXXDXSXNXXXXXXXXXXXXXXXXXXXXXXXXXXNXXXGXXXXXXXXXXXXXXXXXXXXXXXXXXXXXXXXXXXXXXXXXSXXXXXXXXXXXXXXXCXXLXXLNXXXNXXXGXXPXXXXXXXXXXLXXLXLXXNXFXGXXPXXXXXXXXXXXXLXLSXNXXXGXXPXXXXXXXXLXXXXXXXNXXSGXXXXXXXXXXXXXXXXXXXXXNXXXGXXPXXXXNXXXXLXXLDXSXNXXXGXXXXXXXXXXXXXXLXXLXXXXNXXXGXXPXXLXXXXXLXXXXLXXNXLXGXIPXXXXXXXXLXXXXXXXNXLXGXIPXXXXXXXXXXLXXXXLXXNXXXGXIPXXXXXCXXXXWXXLXXNXLXGXIPXXXXXXXXXXXXXXXXXXXXXXXXXXXXXXXXXXXXXXXXXXXXXXXXXXXXXQXGXXXXXXXXGXXXXXXXNXXXXXXCXGXGXLXEFXXIRXXXLXRXXXXXXCXXTXRXYXGXTXXTFXXNGSMXXXDXSYNXXXXXIPXXXGXMXYLXXXNLGHNXXXGXIPXXXXXXXXXXXLDLSXNXXXGXXPXXXXXLXXLXXXXXSNNXLXGXIPXXXXXXTFPXXXXXNNXXLCGXPLXXXCXXXXXXXXXXXXXXHXXXXXXXAXXXXXGXXFSXXCXXXXXXXXXXXXXXXXXXEXXXXXXXYXXXXXXSXXXXXXXXXWXXXXXXXXXXLSINXAXFEKPLXXLTXAXLXXATNGFXXXXXXGSGGFGXVYKAXLXDGXXVAIKKLIXXXGQGDREFXAEMETIGKIKHRNLVPLLGYCKXGXERLLVYXXMKXGSLEXVLHXXXXKKXGXXLNWXXRXKIAXGXARGLAFLHHXCXPHIIHRDMKSSNVLXDEXXEARVSDFGMARLXSXXDTHLSVSTLAGTPGYVPPEYYQSFRCXXKGDVYSYGVXLLELLXGKXPXDXXXFGXDNNLVGWXKXXXXXXXXXXXXDXELXXEXXXXXXELXXXLKXAXXCLDDRXXXRPTMXXVMAMFKEXXAXXXXDSXXXXXXXXXXXXXXXXXXXXXDMXXXEXXEXK

SEQ ID NO: 261 - protein, 90 aa, Artificial Sequence
  consensus sequence
  VARIANT 1, 14, 17, 52, 88: Xaa = His, Lys, or Arg
  VARIANT 5-6, 13, 18-19, 22-23, 33, 50, 55, 67-68, 71-72,77, 79-81, 83-84, 87: Xaa = any amino acid
  VARIANT 7: Xaa = Leu, or Met
  VARIANT 9: Xaa = Ile, or Val
  VARIANT 12: Xaa = Val, or Ile
  VARIANT 20, 34, 66, 70, 86: Xaa = Ile, Leu, Val, or Met
  VARIANT 24: Xaa = Ala, or Gly
  VARIANT 26: Xaa = Ile, or Val
  VARIANT 27, 47, 63: Xaa = Thr, Gly, or Ala
  VARIANT 28: Xaa = Asp, or Lys
  VARIANT 29: Xaa = Asp, or Glu
  VARIANT 30: Xaa = Ala, or Ser
  VARIANT 32: Xaa = Glu, or Asp
  VARIANT 41, 85, 89: Xaa = Phe, Tyr, or Trp
  VARIANT 45: Xaa = Ile, or Val
  VARIANT 46: Xaa = Thr, or Ser
  VARIANT 49: Xaa = Ala, or Leu
  VARIANT 51, 64, 76: Xaa = Glu, or Asp
  VARIANT 54: Xaa = Gln, or His
  VARIANT 57: Xaa = Gln, or Lys
  VARIANT 61: Xaa = Ile, or Val
  VARIANT 62: Xaa = Thr, or Asn
XEQDXXXPXANXXXIMXXXXPXXXKXXXXXKXXXQECVSEXISFXXXEXXXXCXXEXRKTXXXXDXXXAXXXLGFXXYXXXLXXXXXXXR

SEQ ID NO: 262 - protein, 4 aa, Artificial Sequence
  target sequence
KDEL

SEQ ID NO: 263 - protein, 4 aa, Artificial Sequence
  target sequence
HDEL

What is claimed is:

1. A method for making infertile seed, said method comprising:
   a) growing a plurality of apomictic plants, wherein said plants comprise first and second nucleic acids, said first nucleic acid comprising a first transcription activator recognition site and a first promoter, said first recognition site and said first promoter operably linked to a sequence to be transcribed, said second nucleic acid comprising a second transcription activator recognition site and a second promoter, said second recognition site and said second promoter operably linked to a coding sequence that results in seed infertility, wherein said coding sequence that results in seed infertility is SEQ ID NO: 70; and wherein said plants comprise at least one activator nucleic acid comprising at least one coding sequence for a transcription activator that binds to at least one of said recognition sites, each said at least one transcription activator coding sequence having a promoter operably linked thereto, and wherein seeds that form on said plants are infertile, wherein said first and second promoters and said promoter operably linked to said at least one transcription activator coding sequence are selected from a CaMV35S minimal promoter and a rice or maize ubiquitin minimal promoter; wherein said first and second transcription activator recognition sites comprise from 1 to 5 copies of a $UAS_{Hap1}$ upstream activator sequence element; and wherein said transcription activator is a chimeric polypeptide comprising a yeast HAP1 DNA binding domain and a herpes simplex VP16 transcription activator domain.

2. The method of claim 1, wherein said plants are dicotyledonous plants.

3. The method of claim 1, wherein said plants are monocotyledonous plants.

4. The method of claim 1, wherein said sequence to be transcribed encodes a preselected polypeptide.

5. The method of claim 4, wherein expression of said preselected polypeptide confers herbicide resistance.

6. A method for making a polypeptide, said method comprising:
   a) growing a plurality of apomictic plants, each of said plants comprising: i) a first nucleic acid comprising a first transcription activator recognition site and a first promoter, said first recognition site and said first promoter operably linked to a nucleic acid encoding a preselected polypeptide; and ii) a second nucleic acid comprising a second transcription activator recognition site and a second promoter, said second recognition site and said second promoter operably linked to a sequence causing seed infertility, wherein said sequence causing seed infertility is SEQ ID NO: 70 and wherein said plants comprise at least one activator nucleic acid encoding at least one transcription activator that binds to at least one of said recognition sites, each said at least one transcription activator nucleic acid having a promoter operably linked thereto, wherein said first and second promoters and said promoter operably linked to said at least one transcription activator nucleic acid are selected from a CaMV35S minimal promoter and a rice or maize ubiquitin minimal promoters; wherein said first and second transcription activator recognition sites comprise from 1 to 5 copies of a $UAS_{Hap1}$ upstream activator sequence element; and wherein said transcription activator is a chimeric polypeptide comprising a yeast HAP1 DNA binding domain and a herpes simplex VP16 transcription activator domain; and
   b) expressing said preselected polypeptide in said plants, wherein said plants have a statistically significant increase in said preselected polypeptide relative to plants that do not contain or express said first nucleic acid and wherein seeds that develop on said plants are infertile.

7. An article of manufacture comprising:
   a) a container;
   b) apomictic seeds within said container, said seeds comprising at least one first nucleic acid comprising: i) a first transcription activator recognition site and a first promoter, said first recognition site and said first promoter operably linked to a sequence to be transcribed; ii) a second transcription activator recognition site and a second promoter, said second recognition site and said second promoter operably linked to a sequence causing seed infertility wherein said sequence causing seed infertility is SEQ ID NO: 70; and iii) at least one activator nucleic acid encoding at least one transcription activator that binds to at least one of said recognition sites, each said at least one transcription activator nucleic acid having a promoter operably linked thereto, wherein plants grown from said seeds are infertile, wherein said first and second promoters and said promoter operably linked to said at least one transcription activator nucleic acid are selected from a CaMV35S minimal promoter and a rice or maize ubiquitin minimal promoter; wherein said first and second transcription activator recognition sites comprise from 1 to 5 copies of a $UAS_{Hap1}$ upstream activator sequence element; and wherein said transcription activator is a chimeric polypeptide comprising a yeast HAP1 DNA binding domain and a herpes simplex VP16 transcription activator domain.

8. The method of claim 7, wherein said sequence to be transcribed encodes a preselected polypeptide.

9. The article of claim 7, wherein said seeds are dicotyledonous seeds.

10. The article of claim 7, wherein said seeds are monocotyledonous seeds.

11. An apomictic plant comprising:
   a) a first nucleic acid comprising a first transcription activator recognition site and a first promoter, said first recognition site and said first promoter operably linked to a sequence to be transcribed,
   b) a second nucleic acid comprising a second transcription activator recognition site and a second promoter, said second recognition site and said second promoter operably linked to a sequence causing seed infertility, wherein said sequence causing seed infertility is SEQ ID NO:70, and
   c) at least one activator nucleic acid comprising at least one coding sequence for a transcription activator that binds to at least one of said recognition sites, each said at least one transcription activator coding sequence having a promoter operably linked thereto,
   wherein seeds that develop on said plant are infertile, wherein said first and second promoters and said promoter operably linked to said at least one transcription activator coding sequence are selected from a CaMV35S minimal promoter and a rice or maize ubiquitin minimal promoter; wherein said first and second transcription activator recognition sites comprise from 1 to 5 copies of a $UAS_{Hap1}$ upstream activator sequence element; and wherein said transcription activator is a chimeric polypeptide comprising a yeast HAP1 DNA binding domain and a herpes simplex VP16 transcription activator domain.

12. The plant of claim 11, wherein said plant is a dicotyledonous plant.

13. The plant of claim 11, wherein said plant is a monocotyledonous plant.

14. The plant of claim 11, wherein said sequence to be transcribed encodes a preselected polypeptide that confers herbicide resistance.

* * * * *

UNITED STATES PATENT AND TRADEMARK OFFICE
CERTIFICATE OF CORRECTION

PATENT NO. : 7,476,777 B2
APPLICATION NO. : 10/873679
DATED : January 13, 2009
INVENTOR(S) : Peter N. Mascia Page 1 of 1

It is certified that error appears in the above-identified patent and that said Letters Patent is hereby corrected as shown below:

Column 27, line 61 (Claim 6), please delete "promoters" and insert --promoter-- therefor;

Column 28, line 36 (Claim 8), please delete "method" and insert --article-- therefor;

Column 28, line 37 (Claim 8), please delete "encodes" and insert --is-- therefor.

Signed and Sealed this

Sixteenth Day of June, 2009

JOHN DOLL
*Acting Director of the United States Patent and Trademark Office*